US010179936B2

(12) United States Patent
Shak et al.

(10) Patent No.: US 10,179,936 B2
(45) Date of Patent: Jan. 15, 2019

(54) GENE EXPRESSION PROFILE ALGORITHM AND TEST FOR LIKELIHOOD OF RECURRENCE OF COLORECTAL CANCER AND RESPONSE TO CHEMOTHERAPY

(75) Inventors: Steven Shak, Hillsborough, CA (US); Drew Watson, Los Altos, CA (US); Xitong Li, Mountain View, CA (US); Lawrence Lee, San Francisco, CA (US); Kim Clark-Langone, Sunnyvale, CA (US)

(73) Assignee: Genomic Health, Inc., Redwood City, CA (US)

( * ) Notice: Subject to any disclaimer, the term of this patent is extended or adjusted under 35 U.S.C. 154(b) by 1109 days.

(21) Appl. No.: 12/772,136

(22) Filed: Apr. 30, 2010

(65) Prior Publication Data

US 2010/0285980 A1    Nov. 11, 2010

Related U.S. Application Data

(60) Provisional application No. 61/174,890, filed on May 1, 2009, provisional application No. 61/239,420, filed on Sep. 2, 2009.

(51) Int. Cl.
*C12Q 1/6886* (2018.01)
*G06F 19/20* (2011.01)
*G01N 33/574* (2006.01)
*G16H 50/30* (2018.01)
*G06F 19/00* (2018.01)

(52) U.S. Cl.
CPC ..... *C12Q 1/6886* (2013.01); *G01N 33/57419* (2013.01); *G06F 19/00* (2013.01); *G16H 50/30* (2018.01); *C12Q 2600/106* (2013.01); *C12Q 2600/118* (2013.01); *C12Q 2600/158* (2013.01); *G01N 2800/52* (2013.01); *G01N 2800/56* (2013.01)

(58) Field of Classification Search
None
See application file for complete search history.

(56) References Cited

U.S. PATENT DOCUMENTS

| | | |
|---|---|---|
| 6,692,916 B2 | 2/2004 | Bevilacqua et al. |
| 6,960,439 B2 | 11/2005 | Bevilacqua et al. |
| 6,964,850 B2 | 11/2005 | Bevilacqua et al. |
| 7,695,913 B2 | 4/2010 | Cowens et al. |
| 7,767,391 B2 | 8/2010 | Scott et al. |
| 8,008,003 B2 | 8/2011 | Baker et al. |
| 8,026,060 B2 | 9/2011 | Cowens et al. |
| 8,029,995 B2 | 10/2011 | Cowens et al. |
| 8,067,178 B2 | 11/2011 | Baker et al. |
| 8,148,076 B2 | 4/2012 | Baker et al. |
| 8,153,378 B2 | 4/2012 | Cowens et al. |
| 8,153,379 B2 | 4/2012 | Cowens et al. |
| 8,153,380 B2 | 4/2012 | Cowens et al. |
| 2001/0044414 A1 | 11/2001 | Clark et al. |
| 2002/0150922 A1 | 10/2002 | Stolk et al. |
| 2002/0172987 A1 | 11/2002 | Terstappen et al. |
| 2003/0077568 A1 | 4/2003 | Gish et al. |
| 2003/0087818 A1 | 5/2003 | Jiang et al. |
| 2003/0109690 A1 | 6/2003 | Ruben et al. |
| 2003/0148314 A1 | 8/2003 | Berger et al. |
| 2003/0148410 A1 | 8/2003 | Berger et al. |
| 2003/0166064 A1 | 9/2003 | King et al. |
| 2003/0198970 A1 | 10/2003 | Roberts |
| 2003/0219760 A1 | 11/2003 | Gordon et al. |
| 2003/0225526 A1 | 12/2003 | Golub et al. |
| 2004/0053317 A1 | 3/2004 | Glinskii |
| 2005/0014165 A1 | 1/2005 | Lee et al. |
| 2006/0195269 A1 | 8/2006 | Yeatman et al. |
| 2006/0211036 A1 | 9/2006 | Chou et al. |
| 2007/0099209 A1 | 5/2007 | Clarke et al. |
| 2007/0105133 A1 | 5/2007 | Clarke et al. |
| 2007/0166704 A1 | 7/2007 | Huang et al. |
| 2008/0015448 A1 | 1/2008 | Keely et al. |

(Continued)

FOREIGN PATENT DOCUMENTS

| | | |
|---|---|---|
| EP | 1522594 A2 | 4/2005 |
| EP | 1274865 B1 | 2/2007 |

(Continued)

OTHER PUBLICATIONS

Tsujino et al. Stromal Myofibroblasts Predict Disease Recurrence for Colorectal Cancer. Apr. 2, 2007. Clinical Cancer Research. vol. 13, pp. 2082-2090.*
Wagner, J. Overview of biomarkers and surrogate endpoints in drug development. 2002. Disease Markers. vol. 18, pp. 41-46.*
Frank et al. Clinical Biomarkers in Drug Discovery and Development. Jul. 2003. Nature. vol. 2, No. 7, pp. 566-580.*
Feng et al. Research issues and strategies for genomic and proteomic biomarker discovery and validation: a statistical perspective. Sep. 2004. Pharmacogenomics. vol. 5, No. 6, pp. 709-719.*
Golub et al. Molecular Classification of Cancer: Class Discovery and Class Prediction by Gene Expression Monitoring. Oct. 15, 1999. Science. vol. 286, p. 531-537.*

(Continued)

*Primary Examiner* — Channing S Mahatan
(74) *Attorney, Agent, or Firm* — Genomic Health/McNeill Baur PLLC

(57) ABSTRACT

Algorithm-based molecular assays that involve measurement of expression levels of prognostic and/or predictive genes, or co-expressed genes thereof, from a biological sample obtained from a cancer patient, and analysis of the measured expression levels to provide information concerning the likelihood of recurrence of colorectal cancer and/or the likelihood of a beneficial response to chemotherapy for the patient are provided herein. Methods of analysis of gene expression values of prognostic and/or predictive genes, as well as methods of identifying gene expression-tumor region ratios, tumor-associated stromal surface area, and gene cliques, i.e. genes that co-express with a validated biomarker and thus may be substituted for that biomarker in an assay, are also provided.

25 Claims, 34 Drawing Sheets

Specification includes a Sequence Listing.

(56) References Cited

U.S. PATENT DOCUMENTS

| | | |
|---|---|---|
| 2009/0258795 A1 | 10/2009 | Cowens et al. |
| 2009/0298701 A1 | 12/2009 | Baker et al. |
| 2009/0305277 A1 | 12/2009 | Baker et al. |
| 2010/0291573 A1 | 11/2010 | Cowens et al. |
| 2011/0097759 A1 | 4/2011 | Cowens et al. |
| 2011/0111421 A1 | 5/2011 | Cowens et al. |
| 2011/0287958 A1 | 11/2011 | Shak et al. |
| 2012/0040842 A1 | 2/2012 | Baker et al. |
| 2012/0046186 A1 | 2/2012 | Pelham et al. |

FOREIGN PATENT DOCUMENTS

| | | | |
|---|---|---|---|
| JP | 2009-523028 A | 6/2009 | |
| WO | WO9964626 A2 | 12/1999 | |
| WO | WO9964627 A2 | 12/1999 | |
| WO | WO0024940 A1 | 5/2000 | |
| WO | WO0141815 A2 | 6/2001 | |
| WO | WO0212280 A2 | 2/2002 | |
| WO | WO0212328 A2 | 2/2002 | |
| WO | WO0224956 A2 | 3/2002 | |
| WO | WO03050243 A2 | 6/2003 | |
| WO | WO03062395 A2 | 7/2003 | |
| WO | WO2004110345 A2 | 12/2004 | |
| WO | WO2005000087 A2 | 1/2005 | |
| WO | WO2005015236 A2 | 2/2005 | |
| WO | WO2005076005 A2 | 8/2005 | |
| WO | WO2005100593 A1 | 10/2005 | |
| WO | 2005/119260 A2 | 12/2005 | |
| WO | WO2006010150 A2 | 1/2006 | |
| WO | WO2006081248 A2 | 8/2006 | |
| WO | WO2006110581 A2 | 10/2006 | |
| WO | WO2007061876 A2 | 5/2007 | |
| WO | WO2007070621 A2 | 6/2007 | |
| WO | WO2007073220 A1 | 6/2007 | |
| WO | 2007/082099 A2 | 7/2007 | |
| WO | WO 2007/082099 A2 * | 7/2007 | ............... C12Q 1/68 |
| WO | WO2007112330 A2 | 10/2007 | |
| WO | 2008/115419 A2 | 9/2008 | |

OTHER PUBLICATIONS

Anjomshoaa A., et al., "Reduced Expression of a Gene Proliferation Signature is Associated with Enhanced Malignancy in Colon Cancer," British Journal of Cancer, 2008, vol. 99, pp. 966-973.

Arango et al., "Gene-Expression Profiling Predicts Recurrence in Dukes' C Colorectal Cancer", Gastroenterology, 2005, vol. 129, No. 3, pp. 874-884.

Augenlicht et al., "Low-Level C-Myc Amplification in Human Colonic Carcinoma Cell Lines and Tumors: A Frequent, p53-Independent Mutation Associated with Improved Outcome in a Randomized Multi-Institutional Trial," Cancer Research, 1997, vol. 57, pp. 1769-1775.

Avvisato et al., "Mechanical Force Modulates Global Gene Expression and β-Catenin Signaling in Colon Cancer Cells," Journal of Cell Science, 2007, vol. 120, pp. 2672-2682.

Baba et al., "Involvement of Deregulated Epiregulin Expression in Tumorigenesis In Vivo Through Activated Ki-Ras Signaling Pathway in Human Colon Cancer Cells," Cancer Res., 2000, vol. 60, pp. 6886-6889.

Backus, H.H.J. et al., "Differential Expression of Cell Cycle and Apoptosis Related Proteins in Colorectal Mucosa, Primary Colon Tumors, and Liver Metastases," J.Clin.Path., 2002, vol. 55, pp. 206-211.

Barrier, A. et al., "Colon Cancer Prognosis Prediction by Gene Expression Profiling," Oncogene, 2005, vol. 24, pp. 6155-6164.

Barrier A. et al., "Gene Expression Profiling of Nonneoplastic Mucosa May Predict Clinical Outcome of Colon Cancer Patients", Diseases of the Colon and Rectum, 2005, vol. 48, No. 12, pp. 2238-2248.

Batlle E., et al., "EphB Receptor Activity Suppresses Colorectal Cancer Progression," Nature, 2005, vol. 435, pp. 1126-1130.

Bertucci et al., "Gene Expression Profiling of Primary Breast Carcinomas Using Arrays of Candidate Genes", Human Molecular Genetics, 2000, vol. 9, pp. 2981-2991.

Bertucci F., et al.,"Gene Expression Profiling of Colon Cancer by DNA Microarrays and Correlation with Histoclinical Parameters," Oncogene, 2004, vol. 23, pp. 1377-1391.

Bhatavdekar J.M., et al., "Coexpression of Bcl-2, c-Myc, and p53 Oncoproteins as Prognostic Discriminants in Patients with Colorectal Carcinoma," Diseases of the Colon and Rectum, 1997, vol. 40, pp. 785-790.

Bhatavdekar J.M., et al., "Molecular Markers are Predictors of Recurrence and Survival in Patients with Dukes B and Dukes C Colorectal Adenocarcinoma," Diseases of the Colon and Rectum, 2001, vol. 44, pp. 523-533.

Clark-Langone K.M., et al., "Biomarker Discovery for Colon Cancer Using a 761 Gene RT-PCR Assay," BMC Genomics, 2007, vol. 8, pp. 279.

Collett et al., "Overexpression of p65/RelA Potentiates Curcumin-Induced Apoptosis in HCT116 Human Colon Cancer Cells," Carcinogenesis, 2006, vol. 27, pp. 1285-1291.

Compton C., et al., "The Staging of Colorectal Cancer: 2004 and Beyond," CA Cancer J. Clin., 2004, vol. 54, pp. 295-308.

Eschrich S., et al.,"Molecular Staging for Survival Prediction of Colorectal Cancer Patients," J. Clin. Oncol., 2005, vol. 23, pp. 3526-3535.

Friederichs J., et al., "Gene Expression Profiles of Different Clinical Stages of Colorectal Carcinoma: Toward a Molecular Genetic Understanding of Tumor Progression," Int. J. Colorectal Dis., 2005, vol. 20, pp. 391-402.

Glasgow S.C., et al., "Predictive and Prognostic Genetic Markers in Colorectal Cancer," Seminars in Colon and Rectal Surgery, 2005, vol. 15, pp. 163-170.

Henry L.R., et al., "Clinical Implications of Fibroblast Activation Protein in Patients with Colon Cancer," Clinical Cancer Research, 2007, vol. 13, pp. 1736-1741.

Iwasa S., et al., "Increased Expression of Seprase, a Membrane-type Serine Protease, is Associated with Lymph Node Metastasis in Human Colorectal Cancer," Cancer Letters, 2005, vol. 227, pp. 229-236.

Jubb A.M., et al., "EphB2 is a Prognostic Factor in Colorectal Cancer," Clinical Cancer Research, 2005, vol. 11, pp. 5181-5187.

Kakisako K., et al., "Prognostic Significance of c-myc mRNA Expression Assessed by Semi-quantitative RT-PCR in Patients with Colorectal Cancer," Oncology Reports, 1998, vol. 5, pp. 441-445.

Kononen J. et al., "Tissue Microarrays for High-Throughput Molecular Profiling of Tumor Specimens", Nature Medicine, 1998, vol. 4, No. 7, pp. 844-847.

Lee D. et al., "Epiregulin is Not Essential for Development of Intestinal Tumors but is Required for Protection from Intestinal Damage," Mol. Cell. Biol., 2004, vol. 24, pp. 8907-8916.

Lee M. O. et al., "Differential Effects of Retinoic Acid on Growth and Apoptosis in Human Colon Cancer Cell Lines Associated with the Induction of Retinoic Acid Receptor Beta", Biochemical Pharmacology, 2000, vol. 59, No. 5, pp. 485-496.

Liotta L.A., et al., "The Microenvironment of the Tumour-Host Interface," Nature, 2001, vol. 411, pp. 375-379.

Liu W., et al., "Coexpression of Ephrin-Bs and their Receptors in Colon Carcinoma," Cancer, 2002, vol. 94, pp. 934-939.

Liu W., et al., "Effects of Overexpression of Ephrin-B2 on Tumour Growth in Human Colorectal Cancer," British Journal of Cancer, 2004, vol. 90, pp. 1620-1626.

Mesker et al., "The Carcinoma-Stromal Ratio of Colon Carcinoma is an Independent Factor for Survival Compared to Lymph Node Status and Tumor Stage," Cell Oncol., 2007, vol. 29, pp. 387-398.

Mesker et al., "Presence of a High Amount of Stroma and Downregulation of SMAD4 Predict for Worse Survival for Stage I-II Colon Cancer Patients," Cellular Oncology, 2009, vol. 31, pp. 169-178.

Modlich, O. et al., "Predictors of Primary Breast Cancers Responsiveness to Preoperative Epirubicin/Cyclophosphamide-4 Based Chemotherapy: Transition of Microarray Data Into Clinically Useful Predictive Signatures," Journal of Translational Medicine, 2005, vol. 3, pp. 32.

(56) References Cited

OTHER PUBLICATIONS

Nakopoulou, L. et al., "Stromelysin-3 Protein Expression in Invasive Breast Cancer: Relation to Proliferation, Cell Survival and Patients' Outcome," Modern Pathology, 2002, vol. 15, No. 11, pp. 1154-1161.
Nessling et al., "Candidate Genes in Breast Cancer Revealed by Microarray-Based Comparative Genomic Hybridization of Archived Tissue," Cancer Res., 2005, vol. 65, pp. 439-447.
O'Connell M.J., et al., "Relationship Between Tumor Gene Expression and Recurrence in Four Independent Studies of Patients with Stage II/III Colon Cancer Treated with Surgery Alone or Surgery Plus Adjuvant Fluorouracil Plus Leucovorin," Journal of Clinical Oncology, 2010, vol. 28, pp. 3937-3944.
Ogawa S., et al., "The Breakdown of Apoptotic Mechanism in the Development and Progression of Colorectal Carcinoma," J Anticancer Research, 2004, vol. 24, pp. 1569-1580.
Qui et al., "Down-Regulation of Growth Arrest DNA Damage-Inducible Gene 45β Expression is Associated with Human Hepatocellular Carcinoma," American Journal of Pathology, 2003, vol. 162, pp. 1961-1974.
Rosati Gerardo et al., "Thymidylate Synthase Expression p53, Bcl-2, Ki-67 and p27 in Colorectal Cancer: Relationships with Tumor Recurrence and Survival", Tumor Biology, 2004, vol. 25, pp. 258-263.
Sala et al., "B-Myb, a Transcription Factor Implicated in Regulating Cell Cycle, Apoptosis and Cancer," European Journal of Cancer, 2005, vol. 41, pp. 2479-2484.
Sarela A. I. et al., "Expression of the Antiapoptosis Gene Survivin Predicts Death from Recurrent Colorectal Carcinoma," Gut, 2000, vol. 46, No. 5, pp. 645-650.
Scnalan M.J., et al., "Molecular Cloning of Fibroblast Activation Protein Alpha, a Member of the Serine Protease Family Selectively Expressed in Stromal Fibroblasts of Epithelial Cancers," Proceedings of the National Academy of Sciences, 1994, vol. 91, pp. 5657-5661.
Sun Shi Yong, "Retinoic Acid Receptor Beta and Colon Cancer", Cancer Biology and Therapy, 2004, vol. 3, No. 1, pp. 87-88.
Takata et al., "cDNA Array Analysis for Prediction of Hepatic Metastasis of Colorectal Carcinoma," Surg. Today, 2006, vol. 36, pp. 608-614.
Traka et al., "Transcriptome Analysis of Human Colon Caco-2 Cells Exposed to Sulforaphane," Journal of Nutrition, 2005, vol. 135, pp. 1865-1872.
Urruticoechea, A. et al., "Proliferation Marker in Ki-67 in Early Breast Cancer," Journal of Clinical Oncology, 2005, vol. 23, No. 28, pp. 7212-7220.
Wang Y., et al.,"Gene Expression Profiles and Molecular Markers to Predict Recurrence of Dukes' B Colon Cancer," J. Clin. Oncol., 2004, vol. 22, pp. 1564-1571.
Wildi S. et al., "Overexpression of Activin A in Stage IV Colorectal Cancer," Gut, 2001, vol. 49, pp. 409-417.
Williams N.S. et al., "Identification and Validation of Genes Involved in the Pathogenesis of Colorectal Cancer Using cDNA Microarrays and RNA Interference," Clin. Cancer Res., 2003, vol. 9, pp. 931-946.
Youssef Emile M. et al., "Methylation and Regulation of Expression of Different Retinoic Acid Receptor Beta Isoforms in Human Colon Cancer", Cancer Biology and Therapy, 2004, vol. 3, No. 1, pp. 82-86.
U.S. Appl. No. 13/413,338, Cowens et al.
Callagy et al., "Bcl-2 is a Prognostic Marker in Breast Cancer Independently of the Nottingham Prognostic Index," *Clin. Cancer Res.* 12:2468-2475 (2006).
Clark-Langone et al., "Biomarker Discovery for Colon Cancer Using a 761 Gene RT-PCR Assay," *BMC Genomics* 8:279 (2007).
Desmouliere et al., "The Stroma Reaction Myofibroblast: A Key Player in the Control of Tumor Cell Behavior," *Int. J. Dev. Biol.* 48:509-517 (2004).
Mueller et al., "Friends or Foes—Bipolar Effects of the Tumour Stroma in Cancer," *Nature Reviews* 4:839-849 (2004).
Office Action dispatched Sep. 5, 2014, for Japanese Patent Application No. 2012-508805, 12 pages.
Hideyuki Ishida et al., "Ki-67 and CEA expression as prognostic markers in Dukes' C colorectal cancer", Cancer Letters, vol. 207, No. 1, Apr. 2004, pp. 109-115.
Orsolya Galamb et al., "Potential biomarkers of colorectal adenoma-dysplasia-carcinoma progression: mRNA expression profiling and in situ protein detection on TMAs reveal 15 sequentially upregulated and 2 downregulated genes", Cellular Oncology, vol. 31, No. 1, Feb. 2009, pp. 19-29.
Partial European Search Report issued Dec. 3, 2015, for European Patent Application No. EP10770467 (7 pages).
Renfro et al., "Prospective Evaluation of a 12-gene assay on patient treatment decisions and physician confidence in mismatch repair proficient stage IIA colon cancer," Clin Colorectal Cancer: Mar. 2017; 16(1):23-30.
Srivastava et al., "Prospective Multicenter Study of the Impact of Oncotype DX Colon Cancer Assay Results on Treatment Recommendations in Stage II Colon Cancer Patients," The Onocologies 2014; 19:492-497.
Yothers et al., "Validation of the 12-Gene Colon Cancer Recurrence Score in NSABP C-07 As a Predictor of Recurrence in Patients with Stage II and III Colon Cancer Treated with Fluorouracil and Leucovorin (FU/LV) and FU/LV Plus Oxaliplatin," Journal of Clinical Oncology, Dec. 20, 2013; 31(36):4512-4519.

* cited by examiner

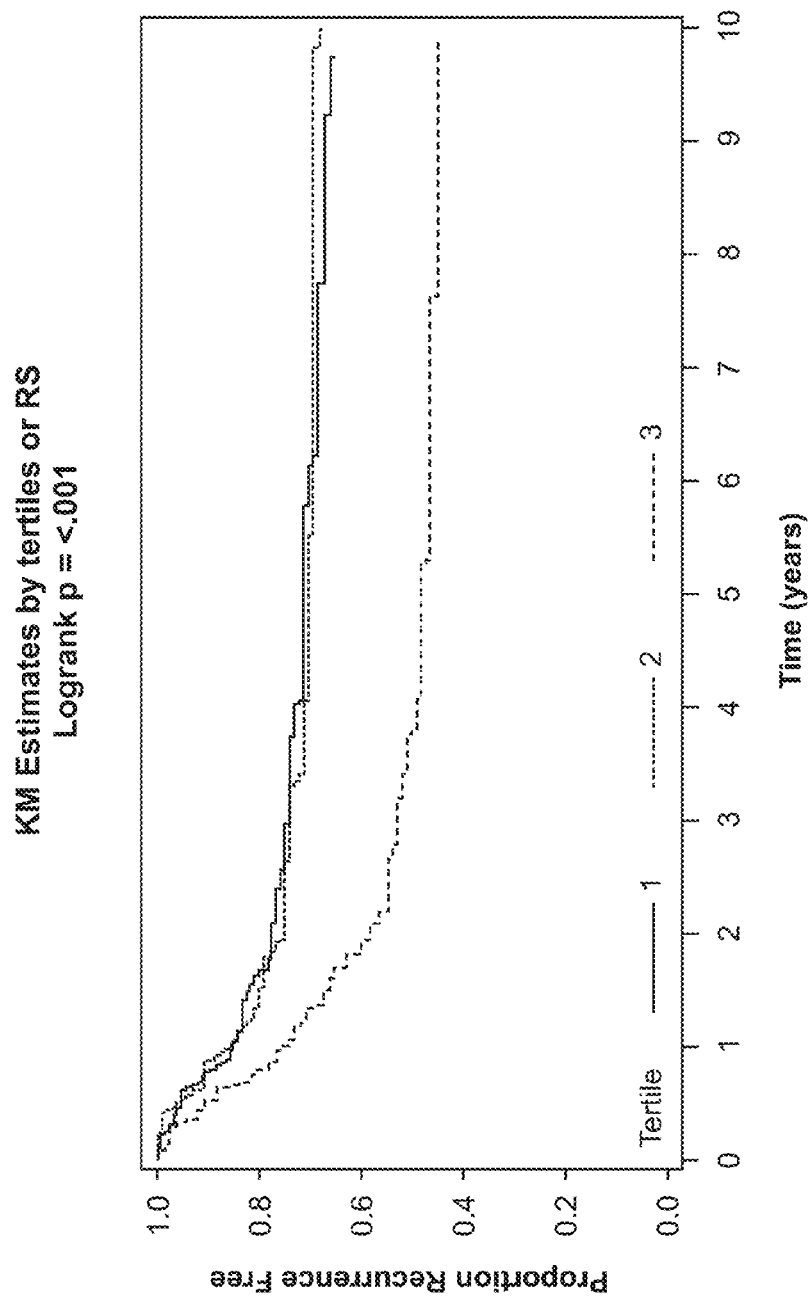

GENE EXPRESSION PROFILE ALGORITHM AND TEST FOR LIKELIHOOD OF RECURRENCE OF COLORECTAL CANCER AND RESPONSE TO CHEMOTHERAPY

CROSS-REFERENCE TO RELATED APPLICATION

This application claims priority benefit of U.S. Provisional Application Ser. No. 61/174,890 filed on May 1, 2009 and U.S. Provisional Application Ser. No. 61/239,420 filed Sep. 2, 2009, each of which is incorporated herein by reference in its entirety.

TECHNICAL FIELD

The present disclosure relates to molecular diagnostic assays that provide information concerning prognosis and prediction of response to chemotherapy in colorectal cancer patients. The present disclosure also provides methods of identifying genes that co-express with one or more biomarker genes.

INTRODUCTION

Colorectal cancer is the third most common malignant neoplasm worldwide, and the second leading cause of cancer-related mortality in the United States and the European Union. It is estimated that there will be approximately 150,000 new cases diagnosed each year in the United States, with about 65% of these being diagnosed as stage II/III colorectal cancer, as discussed below.

Clinical diagnosis of colorectal cancer generally involves evaluating the progression status of the cancer using standard classification criteria. Two classification systems have been widely used in colorectal cancer, the modified Duke's (or Astler-Coller) staging systems and more recently TNM staging as developed by the American Joint Committee on Cancer. Estimates of recurrence risk and treatment decisions in colorectal cancer are currently based primarily on tumor stage.

A series of trials carried out during the 1980's demonstrated that postoperative adjuvant therapy with fluorouracil ("5-FU") and levamisole or leucovorin ("LV") led to a significant survival benefit for colon cancer patients. However, the benefits of adjuvant therapy are not enjoyed equally by all patients. For example, adjuvant 5-FU/LV chemotherapy has been shown to benefit a relatively small (~3%) but statistically significant subset of patients with stage II colon cancer, while the addition of oxaliplatin significantly improved overall DFS with no survival benefit seen in with stage II disease. (See, R. Gray et al., Lancet 370:2020-29 (2007), T. Andre, et al., N Engl J Med (2004), J. Kuebler, et al, J Clin Oncol (2007).) Moreover, significant neurotoxicity and GI toxicity is common and toxic deaths (0.5% in published studies) are well documented in other randomized trials.

These results underline the importance of identifying prognostic and predictive tests which better define for individual patients their likelihood of recurrence and/or magnitude of benefit that they can expect from adjuvant chemotherapy. Under current guidelines, many patients who would be cured by surgery are unnecessarily given adjuvant therapy, while other patients who would benefit from such therapy do not receive it.

SUMMARY

Algorithm-based molecular assays that involve measurement of expression levels of prognostic and/or predictive genes, or co-expressed genes thereof, from a biological sample obtained from a cancer patient, and analysis of the measured expression levels to provide information concerning the likelihood of recurrence of colorectal cancer (Recurrence Score or RS) and/or the likelihood of a beneficial response to chemotherapy (Treatment Score or TS) for the patient are provided herein. Methods of analysis of gene expression values of prognostic and/or predictive genes, as well as methods of identifying gene cliques, i.e. genes that co-express with a validated biomarker and exhibit correlation of expression with the validated biomarker, and thus may be substituted for that biomarker in an assay, are also provided. One skilled in the art would recognize that such substitutions may impact the algorithm, for example the risk profile and weighting of the gene groups may need to be adjusted.

In exemplary embodiments, expression levels of a gene from gene subsets comprising a stromal group and a cell cycle group may be used to calculate a Recurrence Score (RS). The stromal group includes at least one of the following: BGN, FAP, INHBA, or a gene that that co-expresses with BGN, FAP, or INHBA. The cell cycle group includes at least one of the following: MYBL2, Ki-67, cMYC, MAD2L1, or a gene that co-expresses with MYBL2, Ki-67, cMYC, or MAD2L1. In other exemplary embodiments, the stromal gene is BGN and the cell cycle gene is Ki-67.

In exemplary embodiments, gene expression levels of one or more genes from additional gene subsets may be measured and used to calculate the RS, including a cell signaling group, and angiogenesis group, and/or an apoptosis group. The cell signaling group includes GADD45B and genes that co-express with GADD45B. The apoptosis group includes BIK and genes that co-express with BIK. The angiogenesis group includes EFNB2 and genes that co-express with EFNB2. The calculation may be performed on a computer programmed to execute the RS algorithm.

In exemplary embodiments, the method can further include measuring expression levels of predictive genes in a tumor sample obtained from the patient; and calculating a Treatment Score (TS) for the patient using measured gene expression levels, wherein the TS is calculated by assigning the measured expression levels to gene subsets of a TS algorithm, wherein the gene subsets comprise at least one gene each from an MSI group, an apoptosis group, and a stromal group. Calculation of the TS may be performed on a computer programmed to execute the TS algorithm. In exemplary embodiments, a benefit score for the patient based on the RS and the TS may be calculated. In exemplary embodiments, the MSI group can include AXIN2 and genes that co-express with AXIN2. In exemplary embodiments, the apoptosis group can include BIK and genes that co-express with BIK. In exemplary embodiments, the stromal group can include EFNB2 and genes that co-express with EFNB2. In exemplary embodiments, the gene subsets can further include a transcription factor group, where, e.g., the transcription factor group comprises RUNX1 and genes that co-express with RUNX1. In exemplary embodiments, the gene subsets can further include a cell cycle group, where, e.g., the cell cycle group includes MAD2L1 and HSPE1, and genes that co-express with MAD2L1 and HSPE1. In exemplary embodiments, the at least one gene from the gene subsets may be replaced by a substitute gene from the group consisting of RANBP2, BUB1, TOP2A, C20_ORF1, CENPF, STK15, AURKB, HIF1A, UBE2C, and MSH2, and genes that co-express with RANBP2, BUB1, TOP2A, C20_ORF1, CENPF, STK15, AURKB, HIF1A, UBE2C, and MSH2.

In exemplary embodiments, the expression level for each gene subset may be weighted according to a contribution of the gene subset to risk of recurrence and/or response to chemotherapy.

The present disclosure provides methods to analyze gene expression taking into account variability of expression of certain gene subsets within particular regions of the tumor. In exemplary embodiments, this method may be incorporated into a RS algorithm. For example, the gene expression levels for the stromal group may be calculated as a ratio of stromal gene expression values per stroma unit area of a colorectal tumor. Similarly, gene expression levels for the cell cycle group may be calculated as a ratio of cell cycle expression values per epithelial unit area of the colorectal tumor.

The present disclosure provides methods to estimate likelihood of colon cancer recurrence based on analysis of measurements of the surface area of the tumor-associated stroma in a colon tumor sample obtained from a patient. In exemplary embodiments, this method may be incorporated into a RS algorithm.

The present disclosure provides methods to use a threshold value for expression values used in an algorithm-based gene expression analysis, which methods involve measuring an expression level of a gene in a tissue section obtained from a patient; and comparing the measured expression level to a threshold value for said gene; wherein if the threshold value is less than the expression level of said gene, the expression value is used in an expression algorithm, and wherein if the expression level of said gene is greater than or equal to the threshold value, the expression level is used in an expression algorithm.

In exemplary embodiments, the threshold value is based on a $C_t$ value. The threshold value can be, for example, one or more from those listed in Table 3.

The present disclosure provides gene expression analysis methods to identify a gene that is co-expressed with a target gene which methods involve normalizing microarray gene expression data for cancer tumor samples based on array probes; calculating a correlation coefficient based on gene expression levels for every unique pair of array probes; determining significant probe pairs, wherein significant probe pairs are a target gene probe and an array probe with a correlation co-efficient greater than a significant threshold value; mapping the target gene to its corresponding target gene probe, selecting a candidate probe set, wherein each candidate probe is part of a significant probe pair; and identifying a gene associated with each candidate probe; wherein said gene associated with each candidate probe is a co-expressed gene.

The present disclosure also provides methods of assessing gene expression, the method comprising measuring a normalized expression level of a gene in a cancer tumor sample obtained from a patient calculating a ratio of normalized expression of the gene to a tissue unit area in the colorectal sample, wherein the tissue unit area is a tumor-associated stroma unit area or a tumor epithelial unit area; and calculating a recurrence score (RS) or a treatment score (TS) for the patient using the ratio. In related embodiments, the gene is a stromal group gene. In related embodiments, the tissue unit area is a tumor-associated stroma unit area. In further related embodiments, the gene is a cell cycle group gene. In related embodiments, the tissue unit area is a tumor epithelial unit area unit area.

The present disclosure provides methods of determining a prognosis for a cancer patient, comprising measuring a stromal area of a tumor sample obtained from the cancer patient to obtain a Stromal Risk Score, wherein increased stromal area of the tumor sample is positively correlated with an increased risk of recurrence of cancer for said cancer patient, and generating a report based on the Stromal Risk Score. In related embodiments, the tumor sample is a colorectal cancer tumor.

BRIEF DESCRIPTION OF THE DRAWINGS

FIG. 3b is a graph illustrating Kaplan-Meier estimates of recurrence-free interval Stage III patients treated with surgery only, by tertile of recurrence score.

DETAILED DESCRIPTION

Definitions

Figure 1:
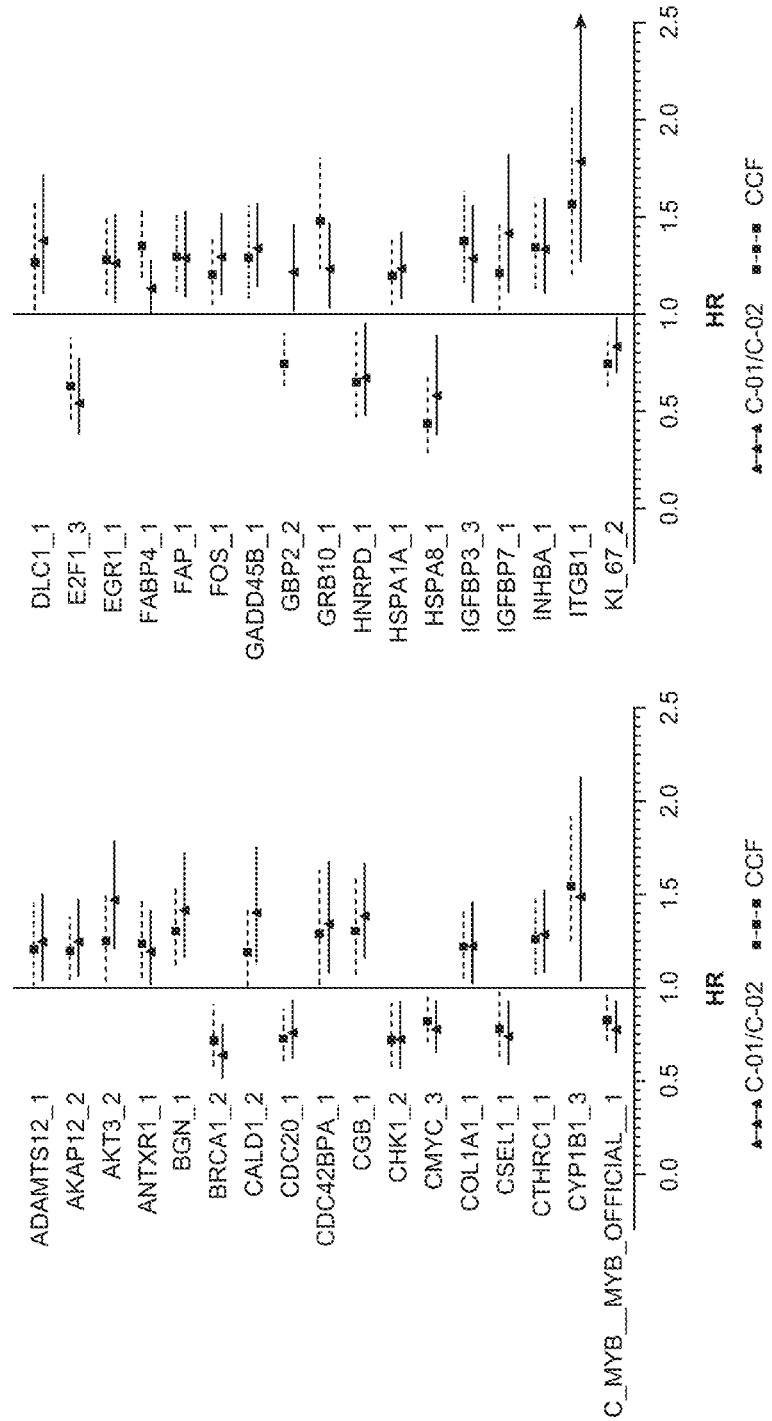
FIG. 1 is a set of graphs providing hazard ratio estimates and 95% confidence intervals for gene expression from univariate Cox PH regression models of recurrence-free interval (RFI) in NSABP C-01/02 patients and CCF patients for the 65 genes that were significantly related to RFI in both studies.
Figure 1:
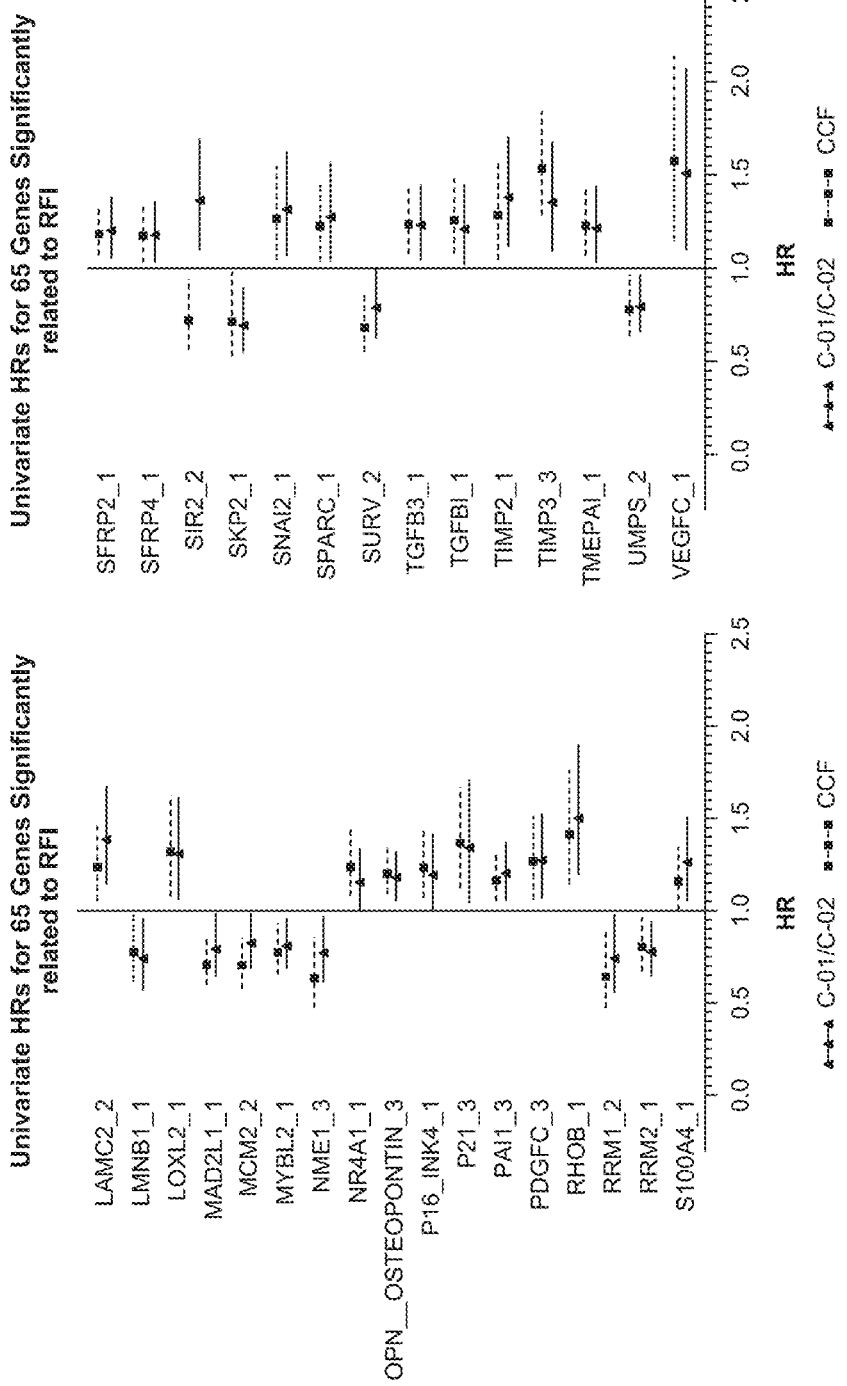

Unless defined otherwise, technical and scientific terms used herein have the same meaning as commonly understood by one of ordinary skill in the art to which this invention belongs. Singleton et al., Dictionary of Microbiology and Molecular Biology 2nd ed., J. Wiley & Sons (New York, N.Y. 1994), and March, Advanced Organic Chemistry Reactions, Mechanisms and Structure 4th ed., John Wiley & Sons (New York, N.Y. 1992), provide one skilled in the art with a general guide to many of the terms used in the present application.

One skilled in the art will recognize many methods and materials similar or equivalent to those described herein, which could be used in the practice of the present invention. Indeed, the present invention is in no way limited to the methods and materials described herein. For purposes of the invention, the following terms are defined below.

The terms "tumor" and "lesion" as used herein, refer to all neoplastic cell growth and proliferation, whether malignant or benign, and all pre-cancerous and cancerous cells and tissues.

The terms "cancer" and "cancerous" refer to or describe the physiological condition in mammals that is typically characterized by unregulated cell growth. Examples of cancer in the present disclosure include cancer of the gastrointestinal tract, such as invasive colorectal cancer or Dukes B (stage II) or Dukes C (stage III) colorectal cancer.

The "pathology" of cancer includes all phenomena that compromise the well-being of the patient. This includes, without limitation, abnormal or uncontrollable cell growth, metastasis, interference with the normal functioning of neighboring cells, release of cytokines or other secretory products at abnormal levels, suppression or aggravation of inflammatory or immunological response, neoplasia, premalignancy, malignancy, invasion of surrounding or distant tissues or organs, such as lymph nodes, etc.

As used herein, the terms "colon cancer" and "colorectal cancer" are used interchangeably and in the broadest sense and refer to (1) all stages and all forms of cancer arising from epithelial cells of the large intestine and/or rectum and/or (2) all stages and all forms of cancer affecting the lining of the large intestine and/or rectum. In the staging systems used for classification of colorectal cancer, the colon and rectum are treated as one organ.

According to the tumor, node, metastasis (TNM) staging system of the American Joint Committee on Cancer (AJCC) (Greene et al. (eds.), AJCC Cancer Staging Manual. 6th Ed. New York, N.Y.: Springer; 2002), the various stages of colorectal cancer are defined as follows:

Tumor: T1: tumor invades submucosal T2: tumor invades muscularis propria; T3: tumor invades through the muscularis propria into the subserose, or into the pericolic or perirectal tissues; T4: tumor directly invades other organs or structures, and/or perforates.

Node: N0: no regional lymph node metastasis; N1: metastasis in 1 to 3 regional lymph nodes; N2: metastasis in 4 or more regional lymph nodes.

Metastasis: M0: mp distant metastasis; M1: distant metastasis present.

Stage groupings: Stage I: T1 N0 M0; T2 N0 M0; Stage II: T3 N0 M0; T4 N0 M0; Stage III: any T, N1-2; M0; Stage IV: any T, any N, M1.

According to the Modified Duke Staging System, the various stages of colorectal cancer are defined as follows:

Stage A: the tumor penetrates into the mucosa of the bowel wall but not further. Stage B: tumor penetrates into and through the muscularis propria of the bowel wall; Stage C: tumor penetrates into but not through muscularis propria of the bowel wall, there is pathologic evidence of colorectal cancer in the lymph nodes; or tumor penetrates into and through the muscularis propria of the bowel wall, there is pathologic evidence of cancer in the lymph nodes; Stage D: tumor has spread beyond the confines of the lymph nodes, into other organs, such as the liver, lung or bone.

Prognostic factors are those variables related to the natural history of colorectal cancer, which influence the recurrence rates and outcome of patients once they have developed colorectal cancer. Clinical parameters that have been associated with a worse prognosis include, for example, lymph node involvement, and high grade tumors. Prognostic factors are frequently used to categorize patients into subgroups with different baseline relapse risks.

The term "prognosis" is used herein to refer to the prediction of the likelihood that a cancer patient will have a cancer-attributable death or progression, including recurrence, metastatic spread, and drug resistance, of a neoplastic disease, such as colon cancer.

The term "prognostic gene" is used herein to refer to a gene, the expression of which is correlated, positively or negatively, with a likelihood of cancer recurrence in a cancer patient treated with the standard of care. A gene may be both a prognostic and predictive gene, depending on the correlation of the gene expression level with the corresponding endpoint. For example, using a Cox proportional hazards model, if a gene is only prognostic, its hazard ratio (HR) does not change when measured in patients treated with the standard of care or in patients treated with a new intervention.

The term "prediction" is used herein to refer to the likelihood that a cancer patient will have a particular clinical response to treatment, whether positive ("beneficial response") or negative, following surgical removal of the primary tumor. For example, treatment could include chemotherapy.

The predictive methods of the present invention can be used clinically to make treatment decisions by choosing the most appropriate treatment modalities for any particular patient. The predictive methods of the present disclosure are valuable tools in predicting if a patient is likely to respond favorably ("beneficial response") to a treatment regimen, such as chemotherapy, surgical intervention, or both. Prediction may include prognostic factors.

The terms "predictive gene" and "response indicator gene" are used interchangeably herein to refer to a gene, the expression level of which is correlated, positively or negatively, with likelihood of beneficial response to treatment with chemotherapy. A gene may be both a prognostic and predictive gene, and vice versa, depending on the correlation of the gene expression level with the corresponding endpoint (e.g., likelihood of survival without recurrence, likelihood of beneficial response to chemotherapy). A predictive gene can be identified using a Cox proportional hazards model to study the interaction effect between gene expression levels from patients treated with treatment A compared to patients who did not receive treatment A (but may have received standard of care, e.g. treatment B). The hazard ratio (HR) for a predictive gene will change when measured in untreated/standard of care patients versus patients treated with treatment A.

As used herein, the term "expression level" as applied to a gene refers to the normalized level of a gene product, e.g. the normalized value determined for the RNA expression level of a gene or for the polypeptide expression level of a gene.

The term "gene product" or "expression product" are used herein to refer to the RNA transcription products (transcripts) of the gene, including mRNA, and the polypeptide translation products of such RNA transcripts. A gene product can be, for example, an unspliced RNA, an mRNA, a splice variant mRNA, a microRNA, a fragmented RNA, a polypeptide, a post-translationally modified polypeptide, a splice variant polypeptide, etc.

The term "RNA transcript" as used herein refers to the RNA transcription products of a gene, including, for example, mRNA, an unspliced RNA, a splice variant mRNA, a microRNA, and a fragmented RNA.

Unless indicated otherwise, each gene name used herein corresponds to the Official Symbol assigned to the gene and provided by Entrez Gene (URL: www.ncbi.nlm.nih.gov/sites/entrez) as of the filing date of this application.

The terms "correlated" and "associated" are used interchangeably herein to refer to a strength of association between two measurements (or measured entities). The disclosure provides genes and gene subsets, the expression levels of which are associated with a particular outcome measure, such as for example between the expression level of a gene and the likelihood of beneficial response to treatment with a drug or microsatellite instability (MSI) phenotype status. For example, the increased expression level of a gene may be positively correlated (positively associated) with an increased likelihood of good clinical outcome for the patient, such as an increased likelihood of long-term survival without recurrence of the cancer and/or beneficial response to a chemotherapy, and the like. Such a positive correlation may be demonstrated statistically in various ways, e.g. by a low hazard ratio. In another example, the increased expression level of a gene may be negatively correlated (negatively associated) with an increased likelihood of good clinical outcome for the patient. In that case, for example, the patient may have a decreased likelihood of long-term survival without recurrence of the cancer and/or beneficial response to a chemotherapy, and the like. Such a negative correlation indicates that the patient likely has a poor prognosis or will respond poorly to a chemotherapy, and this may be demonstrated statistically in various ways, e.g., a high hazard ratio. "Correlated" is also used herein to refer to a strength of association between the expression levels of two different genes, such that expression level of a first gene can be substituted with an expression level of a second gene in a given algorithm in view of their correlation of expression. Such "correlated expression" of two genes that are substitutable in an algorithm usually gene expression levels that are positively correlated with one another, e.g., if increased expression of a first gene is positively correlated with an outcome (e.g., increased likelihood of good clinical outcome), then the second gene that is co-expressed and exhibits correlated expression with the first gene is also positively correlated with the same outcome.

A "positive clinical outcome" and "beneficial response" can be assessed using any endpoint indicating a benefit to the patient, including, without limitation, (1) inhibition, to some extent, of tumor growth, including slowing down and complete growth arrest; (2) reduction in the number of tumor cells; (3) reduction in tumor size; (4) inhibition (i.e., reduction, slowing down or complete stopping) of tumor cell infiltration into adjacent peripheral organs and/or tissues; (5) inhibition of metastasis; (6) enhancement of anti-tumor immune response, possibly resulting in regression or rejection of the tumor; (7) relief, to some extent, of one or more symptoms associated with the tumor; (8) increase in the length of survival following treatment; and/or (9) decreased mortality at a given point of time following treatment. Positive clinical response may also be expressed in terms of various measures of clinical outcome. Positive clinical outcome can also be considered in the context of an individual's outcome relative to an outcome of a population of patients having a comparable clinical diagnosis, and can be assessed using various endpoints such as an increase in the duration of Recurrence-Free interval (RFI), an increase in the time of survival as compared to Overall Survival (OS) in a population, an increase in the time of Disease-Free Survival (DFS), an increase in the duration of Distant Recurrence-Free Interval (DRFI), and the like. An increase in the likelihood of positive clinical response corresponds to a decrease in the likelihood of cancer recurrence.

The term "risk classification" means a level of risk (or likelihood) that a subject will experience a particular clinical outcome. A subject may be classified into a risk group or classified at a level of risk based on the methods of the present disclosure, e.g. high, medium, or low risk. A "risk group" is a group of subjects or individuals with a similar level of risk for a particular clinical outcome.

The term "long-term" survival is used herein to refer to survival for a particular time period, e.g., for at least 3 years, more preferably for at least 5 years.

The term "Recurrence-Free Interval (RFI)" is used herein to refer to the time (in years) from randomization to first colon cancer recurrence or death due to recurrence of colorectal cancer.

The term "Overall Survival (OS)" is used herein to refer to the time (in years) from randomization to death from any cause.

The term "Disease-Free Survival (DFS)" is used herein to refer to the time (in years) from randomization to first colon cancer recurrence or death from any cause.

The term "Distant Recurrence-Free Interval (DRFI)" is used herein to refer to the time (in years) from surgery to the first anatomically distant cancer recurrence.

The calculation of the measures listed above in practice may vary from study to study depending on the definition of events to be either censored or not considered.

The term "tumor-associated stroma unit area" (or "sua") is used herein to refer to a measurement of the tumor-associated stroma area surrounding a tumor. Stroma is the framework or matrix of an organ providing support to the epithelia which includes components such as blood vessels, connective tissues and lymphoid cells. In the colon, tumor-associated stroma is interposed between normal stroma, epithelia, smooth muscle and malignant epithelial cells.

The term "tumor epithelial unit area" (or "cua") is used herein to refer to a measurement of the epithelial area of a tumor which comprises cancerous (e.g., malignant) epithelial cells. In the colon, the tumor associated epithelia cells are glandular in form, genomically clonal and are referred to as the adenocarcinoma.

The term "stromal area" as used herein, refers to the surface area of colon tumor-associated stroma in a biological sample obtained from a patient sample. The stromal area may be measured by any suitable method, such as by micrometer, or standard or digital microscopic assessment of a Hematoxylin and Eosin (H&E) section.

The term "Stromal Risk," as used herein, refers to an estimate of recurrence risk of a patient with colon cancer based on stromal area. The amount of stromal area in a colon cancer tumor obtained from a patient is associated with the risk of recurrence of colon cancer for that patient. The greater the amount of stromal area present, the greater the risk of colon cancer recurrence. This estimate may be, for example, provided in the form of a Stromal Risk Score or Group that reflects the likelihood that a colon cancer patient will have a recurrence, such as a numeric range, descriptive categories (low, intermediate, high), etc.

The term "microarray" refers to an ordered arrangement of hybridizable array elements, e.g. oligonucleotide or polynucleotide probes, on a substrate.

The term "polynucleotide," when used in singular or plural, generally refers to any polyribonucleotide or polydeoxyribonucleotide, which may be unmodified RNA or DNA or modified RNA or DNA. Thus, for instance, polynucleotides as defined herein include, without limitation, single- and double-stranded DNA, DNA including single- and double-stranded regions, single- and double-stranded RNA, and RNA including single- and double-stranded regions, hybrid molecules comprising DNA and RNA that may be single-stranded or, more typically, double-stranded or include single- and double-stranded regions. In addition, the term "polynucleotide" as used herein refers to triple-stranded regions comprising RNA or DNA or both RNA and DNA. The strands in such regions may be from the same molecule or from different molecules. The regions may include all of one or more of the molecules, but more typically involve only a region of some of the molecules. One of the molecules of a triple-helical region often is an oligonucleotide. The term "polynucleotide" specifically includes cDNAs. The term includes DNAs (including cDNAs) and RNAs that contain one or more modified bases. Thus, DNAs or RNAs with backbones modified for stability or for other reasons, are "polynucleotides" as that term is intended herein. Moreover, DNAs or RNAs comprising unusual bases, such as inosine, or modified bases, such as tritiated bases, are included within the term "polynucleotides" as defined herein. In general, the term "polynucleotide" embraces all chemically, enzymatically and/or metabolically modified forms of unmodified polynucleotides, as well as the chemical forms of DNA and RNA characteristic of viruses and cells, including simple and complex cells.

The term "oligonucleotide" refers to a relatively short polynucleotide, including, without limitation, single-stranded deoxyribonucleotides, single- or double-stranded ribonucleotides, RNArDNA hybrids and double-stranded DNAs. Oligonucleotides, such as single-stranded DNA probe oligonucleotides, are often synthesized by chemical methods, for example using automated oligonucleotide synthesizers that are commercially available. However, oligonucleotides can be made by a variety of other methods, including in vitro recombinant DNA-mediated techniques and by expression of DNAs in cells and organisms.

As used herein, the term "expression level" as applied to a gene refers to the level of the expression product of a gene, e.g. the normalized value determined for the RNA expression product of a gene or for the polypeptide expression level of a gene.

The term "$C_t$" as used herein refers to threshold cycle, the cycle number in quantitative polymerase chain reaction (qPCR) at which the fluorescence generated within a reaction well exceeds the defined threshold, i.e. the point during the reaction at which a sufficient number of amplicons have accumulated to meet the defined threshold.

The terms "threshold" or "thresholding" refer to a procedure used to account for non-linear relationships between gene expression measurements and clinical response as well as to further reduce variation in reported patient scores. When thresholding is applied, all measurements below or above a threshold are set to that threshold value. Non-linear relationship between gene expression and outcome could be examined using smoothers or cubic splines to model gene expression in Cox PH regression on recurrence free interval or logistic regression on recurrence status. Variation in reported patient scores could be examined as a function of variability in gene expression at the limit of quantitation and/or detection for a particular gene.

As used herein, the term "amplicon," refers to pieces of DNA that have been synthesized using amplification techniquest, such as polymerase chain reactions (PCR) and ligase chain reactions.

"Stringency" of hybridization reactions is readily determinable by one of ordinary skill in the art, and generally is an empirical calculation dependent upon probe length, washing temperature, and salt concentration. In general, longer probes require higher temperatures for proper annealing, while shorter probes need lower temperatures. Hybridization generally depends on the ability of denatured DNA to re-anneal when complementary strands are present in an environment below their melting temperature. The higher the degree of desired homology between the probe and hybridizable sequence, the higher the relative temperature which can be used. As a result, it follows that higher relative temperatures would tend to make the reaction conditions more stringent, while lower temperatures less so. For additional details and explanation of stringency of hybridization reactions, see Ausubel et al., Current Protocols in Molecular Biology, Wiley Interscience Publishers, (1995).

"Stringent conditions" or "high stringency conditions", as defined herein, typically: (1) employ low ionic strength and high temperature for washing, for example 0.015 M sodium chloride/0.0015 M sodium citrate/0.1% sodium dodecyl sulfate at 50° C.; (2) employ during hybridization a denaturing agent, such as formamide, for example, 50% (v/v) formamide with 0.1% bovine serum albumin/0.1% Ficoll/0.1% polyvinylpyrrolidone/50 mM sodium phosphate buffer at pH 6.5 with 750 mM sodium chloride, 75 mM sodium citrate at 42° C.; or (3) employ 50% formamide, 5×SSC (0.75 M NaCl, 0.075 M sodium citrate), 50 mM sodium phosphate (pH 6.8), 0.1% sodium pyrophosphate, 5×Denhardt's solution, sonicated salmon sperm DNA (50 μg/ml), 0.1% SDS, and 10% dextran sulfate at 42° C., with washes at 42° C. in 0.2×SSC (sodium chloride/sodium citrate) and 50% formamide, followed by a high-stringency wash consisting of 0.1×SSC containing EDTA at 55° C.

"Moderately stringent conditions" may be identified as described by Sambrook et al., Molecular Cloning: A Laboratory Manual, New York: Cold Spring Harbor Press, 1989, and include the use of washing solution and hybridization conditions (e.g., temperature, ionic strength and % SDS) less stringent that those described above. An example of moderately stringent conditions is overnight incubation at 37° C. in a solution comprising: 20% formamide, 5×SSC (150 mM NaCl, 15 mM trisodium citrate), 50 mM sodium phosphate (pH 7.6), 5×Denhardt's solution, 10% dextran sulfate, and 20 mg/ml denatured sheared salmon sperm DNA, followed by washing the filters in 1×SSC at about 37-50° C. The skilled artisan will recognize how to adjust the temperature, ionic strength, etc. as necessary to accommodate factors such as probe length and the like.

The terms "splicing" and "RNA splicing" are used interchangeably and refer to RNA processing that removes introns and joins exons to produce mature mRNA with continuous coding sequence that moves into the cytoplasm of an eukaryotic cell.

As used herein, the term "exon" refers to any segment of an interrupted gene that is represented in the mature RNA product. As used herein, the term "intron" refers to any segment of DNA that is transcribed but removed from within the transcript by splicing together the exons on either side of it. "Intronic RNA" refers to mRNA derived from an intronic region of DNA. Operationally, exonic sequences occur in the mRNA sequence of a gene as defined by Ref. SEQ ID numbers. Operationally, intron sequences are the intervening sequences within the genomic DNA of a gene.

The term "co-expressed", as used herein, refers to a statistical correlation between the expression level of one gene and the expression level of another gene. Pairwise co-expression may be calculated by various methods known in the art, e.g., by calculating Pearson correlation coefficients or Spearman correlation coefficients. Co-expressed gene cliques may also be identified using a graph theory. An analysis of co-expression may be calculated using normalized expression data.

A "computer-based system" refers to a system of hardware, software, and data storage medium used to analyze information. The minimum hardware of a patient computer-based system comprises a central processing unit (CPU), and hardware for data input, data output (e.g., display), and data storage. An ordinarily skilled artisan can readily appreciate that any currently available computer-based systems and/or components thereof are suitable for use in connection with the methods of the present disclosure. The data storage medium may comprise any manufacture comprising a recording of the present information as described above, or a memory access device that can access such a manufacture.

To "record" data, programming or other information on a computer readable medium refers to a process for storing information, using any such methods as known in the art. Any convenient data storage structure may be chosen, based on the means used to access the stored information. A variety of data processor programs and formats can be used for storage, e.g. word processing text file, database format, etc.

A "processor" or "computing means" references any hardware and/or software combination that will perform the functions required of it. For example, a suitable processor may be a programmable digital microprocessor such as available in the form of an electronic controller, mainframe, server or personal computer (desktop or portable). Where the processor is programmable, suitable programming can be communicated from a remote location to the processor, or previously saved in a computer program product (such as a portable or fixed computer readable storage medium, whether magnetic, optical or solid state device based). For example, a magnetic medium or optical disk may carry the programming, and can be read by a suitable reader communicating with each processor at its corresponding station.

As used herein, the term "surgery" applies to surgical methods undertaken for removal of cancerous tissue, including resection, laparotomy, colectomy (with or without lymphadenectomy), ablative therapy, endoscopic removal, excision, dissection, and tumor biopsy/removal. The tumor tissue or sections used for gene expression analysis may have been obtained from any of these methods.

As used herein, "graph theory" refers to a field of study in Computer Science and Mathematics in which situations are represented by a diagram containing a set of points and lines connecting some of those points. The diagram is referred to as a "graph", and the points and lines referred to as "vertices" and "edges" of the graph. In terms of gene co-expression analysis, a gene (or its equivalent identifier, e.g. an array probe) may be represented as a node or vertex in the graph. If the measures of similarity (e.g., correlation coefficient, mutual information, alternating conditional expectation) between two genes is higher than a significant threshold, the two genes are said to be co-expressed and an edge will be drawn in the graph. When co-expressed edges for all possible gene pairs for a given study have been drawn, all maximal cliques are computed. The resulting maximal clique is defined as a gene clique. A gene clique is a computed co-expressed gene group that meets predefined criteria.

As used herein, the terms "gene clique" and "clique" refer to a subgraph of a graph in which every vertex is connected by an edge to every other vertex of the subgraph.

As used herein, a "maximal clique" is a clique in which no other vertex can be added and still be a clique.

Reference to "markers for prediction of response" with reference to 5-fluorouracil (5-FU), and like expressions, encompass within their meaning response to treatment comprising 5-FU as monotherapy, or in combination with other agents, or as prodrugs, or together with local therapies such as surgery and radiation, or as adjuvant or neoadjuvant chemotherapy, or as part of a multimodal approach to the treatment of neoplastic disease.

As used herein, the terms "5-FU-based therapy", "5-FU based treatment", and "5-FU therapy" are used interchangeably to refer to encompass administration of 5-FU or a prodrug thereof and further encompasses administration of 5-FU combination or 5-FU combination therapy.

"5-FU combination" or "5-FU combination therapy" refers to a combination of 5-FU and another agent. A number of agents have been combined with 5-FU to enhance the cytotoxic activity through biochemical modulation. Addition of exogenous folate in the form of 5-formyl-tetrahydrofolate (leucovorin) sustains inhibition of thymidylate synthase. Methotrexate, by inhibiting purine synthesis and increasing cellular pools of certain substrates for reactivity with 5-FU, enhances the activation of 5-FU. The combination of cisplatin and 5-FU increases the antitumor activity of 5-FU. Oxaliplatin is commonly used with 5-FU and leucovorin for treating colorectal cancer, and it may inhibit catabolism of 5-FU, perhaps by inhibiting dihydropyrimidine dehydrogenase (the enzyme that is responsible for the catabolism of 5-FU), and may also inhibit expression of thymidylate synthase. The combination of 5-FU and irinotecan, a topoisomerase-1 inhibitor, is a treatment that combines 5-FU with an agent that has a different mechanism of action. Eniluracil, which is an inactivator of dihydropyrimidine dehydrogenase, leads to another strategy for improving the efficacy of 5-FU.

"5-FU prodrug" refers to drugs that, following administration to a patient, provide for activity of 5-FU. A number of 5-FU prodrugs have been developed. For example, capecitabine (N4-pentoxycarbonyl-5'-deoxy-5-fluorcytidine) is an orally administered agent that is approved by the FDA for certain treatments including colorectal cancer. Another fluoropyrimidine that acts as a prodrug for 5-FU is florafur.

Algorithm-Based Methods and Gene Subsets

The present disclosure provides an algorithm-based molecular diagnostic assay for determining an expected clinical outcome (prognostic) and/or the likelihood that a patient with cancer will have a clinically beneficial response to chemotherapy (predictive). For example, the expression levels of the prognostic genes may be used to calculate a likelihood of colorectal cancer recurrence. The expression levels of the predictive genes, and in some cases the predictive and prognostic genes, may be used to calculate the likelihood that a patient with colorectal cancer will have a clinically beneficial response to chemotherapy. The cancer can be, for example, Stage II and/or Stage III colorectal cancer. The chemotherapy can be, for example, a 5-FU-based chemotherapy.

The present disclosure provides methods to classify a tumor based on the likelihood of cancer recurrence for a patient. The likelihood of recurrence is calculated based on expression levels of prognostic genes from particular gene subsets, wherein gene subsets include at least one gene each from a stromal group and a cell cycle group. Prognostic gene subsets may also include at least one gene from a cell signaling group, an apoptosis group, and/or a transcription factor group.

The present disclosure provides methods of classifying a tumor according to the likelihood that a patient with cancer will have a beneficial response to chemotherapy based on expression levels of predictive genes. The likelihood of a beneficial response is calculated based on expression levels of predictive genes from particular gene subsets, wherein the gene subsets include at least one gene from each of a stromal group, an apoptosis group, and a MSI group. Predictive gene subsets can also include at least one gene from a transcription factor group and/or a cell cycle group.

The gene subset identified herein as the "stromal group" includes genes that are synthesized predominantly by stromal cells and are involved in stromal response and genes that co-express with stromal group genes. "Stromal cells" are defined herein as connective tissue cells that make up the support structure of biological tissues. Stromal cells include fibroblasts, immune cells, pericytes, endothelial cells, and inflammatory cells. "Stromal response" refers to a desmoplastic response of the host tissues at the site of a primary tumor or invasion. See, e.g., E. Rubin, J. Farber, Pathology, 985-986 ($2^{nd}$ Ed. 1994). The stromal group includes, for example, BGN, FAP, INHBA, and genes that are co-expressed with BGN, FAP, or INHBA, wherein a gene is said to be co-expressed with a stromal gene when the expression level of the gene exhibits a Pearson correlation coefficient greater than or equal to 0.6. For example, the stromal group includes the genes and/or gene cliques shown in Tables 4, 5 and 6 (provided in specification just prior to claims). The combination of genes used from within the stromal group can vary with the method of analysis for which expression is to be evaluated. For example, the stromal group for classifying a tumor according to the likelihood of colorectal cancer recurrence includes BGN, FAP and INHBA. The gene subset herein identified as the "cell cycle group" includes genes that are involved with cell cycle functions and genes that co-express with cell cycle group genes. "Cell cycle functions" are defined herein as cell proliferation and cell cycle control, e.g. checkpoint/G1 to S phase transition. The cell cycle group thus includes genes that (1) are involved in biological pathways associated with cell cycle functions; and (2) co-express with Ki-67, cMYC, MYBL2, MAD2L1, or HSPE1, with a Pearson correlation coefficient greater than or equal to 0.4. Exemplary co-expressed genes and/or gene cliques for Ki-67, cMYC, MYBL2, MAD2L1, and HSPE1 are provided in Tables 5 and 6. The combination of genes used from within the cell cycle group can vary with the method of analysis for which expression is to be evaluated. For example, the cell cycle group for classifying a tumor according to the likelihood of colorectal cancer recurrence includes Ki-67, cMYC, MYBL2, MAD2L1, and HSPE1. The cell cycle group for classifying a tumor according to likelihood that a patient will have a beneficial response to chemotherapy includes MAD2L1 and HSPE1.

This specification discloses data demonstrating that genes associated with the stroma of a tumor are associated with an increased risk of recurrence, whereas cell cycle genes are correlated with a decreased risk of recurrence. In addition, the present disclosure provides prognostic and predictive methods that take into account the observation that expression levels for certain genes vary with respect to the regions of a tumor.

Specifically, the present disclosure provides evidence that there are higher expression levels of (1) the stromal genes in the tumor-associated stroma; and (2) the cell cycle genes in the luminal part of the tumor. The ratios of expression levels to tumor region areas vary from patient to patient. This ratio of expression between tumor-associated stroma and the luminal part of the tumor can be exploited in the prognostic and predictive methods disclosed herein.

In exemplary embodiments, expression values of stromal genes may be calculated using stromal gene expression per stroma unit area, and expression values of cell cycle genes may be calculated using cell cycle gene expression per epithelial unit area. Thus, the area of the tumor-associated stroma and the area of the tumor-luminal regions may be taken into account by the prognostic and predictive algorithms in order to increase reproducibility and accuracy of RFI prediction and prediction of response to therapy, respectively. One skilled in the art would recognize that there are many conventional methods available to capture percent stroma and percent epithelia. For example, such ratios could be obtained by examining the H&E slide immediately adjacent to the tissue sections to be analyzed. This could be performed by either a pathologist (to get a gross measurement) or by digital image analysis (to obtain a more precise measurement).

In addition, the present disclosure provides evidence that measurement of the stroma area has prognostic value to colon cancer patients. Specifically, the stromal surface area of the tumor-associate stromal region of a tumor is positively correlated with increase risk of recurrence. This risk of recurrence may be reported in the form of a Stromal Risk score, or combined with risk information obtained from other sources, such as a Recurrence Score The gene subset herein identified as the "angiogenesis group" includes genes that regulate new blood capillary formation or that otherwise participate in "wound healing." The angiogenesis group includes genes that (1) are involved in biological pathways associated with wound healing functions; and (2) co-express with EFNB2 with a Peason correlation coefficient greater than or equal to 0.6.

The gene subset defined herein as the "apoptosis group" includes genes which are involved in apoptosis functions and genes that co-express with apoptosis group genes. "Apoptosis functions" are defined herein as a series of cellular signaling intended to positively or negatively induce apoptosis, or programmed cell death. The apoptosis group includes BIK and genes that co-express with BIK with a Pearson correlation coefficient greater than or equal to 0.6. The gene subset defined herein as the "cell signaling group" includes genes which are involved with signaling pathways impacting cell growth and apoptosis and genes that co-express with cell signaling group genes. The cell signaling group includes GADD45B and genes that co-express with GADD45B, with a Pearson correlation coefficient greater than or equal to 0.6. Exemplary genes that co-express with GADD45B are provided in Tables 4 and 5. Table 4 provides genes for which expression is highly correlated with validated prognostic and/or predictive genes (by rank and Pearson co-expression co-efficient). Table 5 provides the results of identification of genes through gene module/clique analysis of validated gene biomarkers.

The gene subset herein defined as the "transcription factor group" includes genes which are involved with transcription factor functions and genes that co-express with transcription factor group genes. "Transcription factor functions" are defined herein as the binding of specific DNA sequences to facilitate the transcription of DNA to RNA, either alone or as part of a complex. The transcription factor group includes RUNX1 and genes that co-express with RUNX1 with a Pearson correlation coefficient greater than or equal to 0.6. Exemplary co-expressed genes and/or gene cliques encompassed by the transcription factor group are provided in Tables 5 and 6.

The gene subset defined herein as the "MSI group" includes genes which are known to have a statistically significant correlation with microsatellite instability high (MSI-H) status and genes that co-express with MSI group genes. Practice guidelines indicate that MSI-H histology is one factor to consider in making cancer screening recommendations for colorectal cancer patients. (See, e.g., NCCN Practice Guidelines in Oncology, v.2.2008.) The MSI group includes AXIN2 and genes that are (1) significantly associated with MSI-H status; or (2) co-express with AXIN2 with a correlation coefficient greater than or equal to 0.4. Exemplary co-expressed genes and/or gene cliques encompassed by the MSI group are provided in Table 5.

The present disclosure also provides methods to determine a threshold expression level for a particular gene. A threshold expression level may be calculated for a prognostic or predictive gene. A threshold expression level for a gene may be based on a normalized expression level. In one example, a $C_t$ threshold expression level may be calculated by assessing functional forms using logistic regression.

The disclosure further provides methods to determine genes that co-express with particular target genes identified by quantitative RT-PCR (qRT-PCR), e.g. validated biomarkers relevant to a particular type of cancer. The co-expressed genes are themselves useful biomarkers. The co-expressed genes may be substituted for the prognostic or predictive gene marker with which they co-express. The methods can include identifying gene cliques from microarray data, normalizing the microarray data, computing a pairwise Spearman correlation matrix for the array probes, filtering out significant co-expressed probes across different studies, building a graph, mapping the probe to genes, and generating a gene clique report. For example, the expression levels of one or more genes of a prognostic and/or predictive gene clique may be used to calculate the likelihood that a patient with colorectal cancer will experience a recurrence and/or respond to chemotherapy. A "prognostic gene clique", as used herein, refers to a gene clique that includes a prognostic gene. A "predictive gene clique", as used herein, refers to a gene clique that includes a predictive gene.

Various technological approaches for determination of expression levels of the disclosed genes are set forth in this specification, including, without limitation, RT-PCR, microarrays, high-throughput sequencing, serial analysis of gene expression (SAGE) and Digital Gene Expression (DGE), which will be discussed in detail below. In particular aspects, the expression level of each gene may be determined in relation to various features of the expression products of the gene including exons, introns, protein epitopes and protein activity. One or more of the prognostic and/or predictive genes, or their expression products, may be analyzed for microsatellite instability (MSI) status.

The expression levels of prognostic and/or predictive genes may be measured in tumor tissue. For example, the tumor tissue is obtained upon surgical removal or resection of the tumor, or by tumor biopsy. The expression level of prognostic and/or predictive genes may also be measured in tumor cells recovered from sites distant from the tumor, for example circulating tumor cells, body fluid (e.g., urine, blood, blood fraction, etc.).

The expression product that is assayed can be, for example, RNA or a polypeptide. The expression product may be fragmented. For example, the assay may use primers that are complementary to target sequences of an expression product and could thus measure full transcripts as well as those fragmented expression products containing the target sequence. Further information is provided in Tables A and B (inserted in specification prior to claims).

The RNA expression product may be assayed directly or by detection of a cDNA product resulting from a PCR-based amplification method, e.g., quantitative reverse transcription polymerase chain reaction (qRT-PCR). (See e.g., U.S. Pub. No. US2006-0008809A1.) Polypeptide expression product may be assayed using immunohistochemistry (IHC). Further, both RNA and polypeptide expression products may also be is assayed using microarrays.

Clinical Utility

The algorithm-based assay and associated information provided by the practice of the methods disclosed herein facilitates physicians in making more well-informed treatment decisions, and to customize the treatment of colorectal cancer to the needs of individual patients, thereby maximizing the benefit of treatment and minimizing the exposure of patients to unnecessary treatments which may provide little or no significant benefits and often carry serious risks due to toxic side-effects.

Multi-analyte gene expression tests can be used measure the expression level of one or more genes involved in each of several relevant physiologic processes or component cellular characteristics.

The algorithm used to calculate such a score in a method disclosed herein may group the expression level values of genes. The grouping of genes may be performed at least in part based on knowledge of the contribution of the genes according to physiologic functions or component cellular characteristics, such as in the groups discussed above. The formation of groups, in addition, can facilitate the mathematical weighting of the contribution of various expression levels to the recurrence and/or treatment scores. The weighting of a gene group representing a physiological process or component cellular characteristic can reflect the contribution of that process or characteristic to the pathology of the cancer and clinical outcome. Accordingly, the present disclosure provides subsets of the prognostic and predictive genes identified herein for use in the methods disclosed herein.

Based on the determination of a recurrence and/or treatment score, patients can be partitioned into subgroups (e.g., tertiles or quartiles) based on a selected value(s) of the recurrence and/or treatment score(s), where all patients with values in a given range can be classified as belonging to a particular risk group or treatment benefit group. Thus, the values chosen will define subgroups of patients with respectively greater or lesser risk and/or greater or lesser benefit.

The utility of a gene marker in predicting colorectal cancer outcome and/or response to chemotherapy may not be unique to that marker. An alternative marker having an expression pattern that is parallel to that of a selected marker gene may be substituted for, or used in addition to, a test marker. Due to the co-expression of such genes, substitution of expression level values should have little impact on the overall prognostic and/or predictive utility of the test. The closely similar expression patterns of two genes may result from involvement of both genes in the same process and/or being under common regulatory control in colon tumor cells. The present disclosure thus contemplates the use of such co-expressed genes or gene sets as substitutes for, or in addition to, prognostic and/or predictive methods of the present disclosure.

The present methods can provide for identification of colorectal cancer patients are likely to recur after surgery, and who will benefit from adjuvant chemotherapy. Such methods can be used alone or in combination with other clinical methods for patient stratification, e.g., using pathologic (tumor grade and histology) or molecular markers (e.g., levels of expression of genes such as thymidine synthase, thymidine phosphorylase (TP), dihydropyrimidine dehydrogenase (DPD), or microsatellite instability (MSI) status).

The algorithm-based molecular assay and associated information provided by the methods disclosed herein for predicting the clinical outcome in Stage II and/or Stage III cancers of the colon and/or rectum have utility in many areas, including in the development and appropriate use of drugs to treat Stage II and/or Stage III cancers of the colon and/or rectum, to stratify cancer patients for inclusion in (or exclusion from) clinical studies, to assist patients and physicians in making treatment decisions, provide economic benefits by targeting treatment based on personalized genomic profile, and the like. For example, the recurrence score may be used on samples collected from patients in a clinical trial and the results of the test used in conjunction with patient outcomes in order to determine whether subgroups of patients are more or less likely to show a response to a new drug than the whole group or other subgroups. Further, such methods can be used to identify from clinical data subsets of patients who can benefit from therapy. Additionally, a patient is more likely to be included in a clinical trial if the results of the test indicate a higher likelihood that the patient will have a poor clinical outcome if treated with surgery alone and a patient is less likely to be included in a clinical trial if the results of the test indicate a lower likelihood that the patient will have a poor clinical outcome if treated with surgery alone.

Staging of rectal tumors can be carried out based on similar criteria as for colon tumor staging, although there are some differences resulting, for example, from differences in the arrangement of the draining lymph nodes. As a result, Stage II/III rectal tumors bear a reasonable correlation to Stage II/III colon tumors as to their state of progression. As noted above, the rate of local recurrence and other aspects of prognosis differ between rectal cancer and colon cancer, and these differences may arise from difficulties in accomplishing total resection of rectal tumors. Nevertheless, there is no compelling evidence that there is a difference between colon cancer and rectal cancer as to the molecular characteristics of the respective tumors. Tests able to predict chemotherapy treatment benefit for rectal cancer patients have utility similar in nature as described for colon cancer tests and the same markers might well have utility in both cancer types.

Tests that identify patients more likely to be those that fail to respond to standard-of-care are useful in drug development, for example in identifying patients for inclusion in clinical trials testing the efficacy of alternative drugs. For example, 30-35% of Stage III colon cancer patients fail to survive five years when treated with fluorouracil-based chemotherapy after surgical resection of tumor. Preferential inclusion of these patients in a clinical trial for a new Stage III colon cancer treatment could substantially improve the efficiency and reduce the costs of such a clinical trial.

Methods of Assaying Expression Levels of a Gene Product

The methods and compositions of the present disclosure will employ, unless otherwise indicated, conventional techniques of molecular biology (including recombinant techniques), microbiology, cell biology, and biochemistry, which are within the skill of the art. Exemplary techniques are explained fully in the literature, such as, "Molecular Cloning: A Laboratory Manual", $2^{nd}$ edition (Sambrook et al., 1989); "Oligonucleotide Synthesis" (M. J. Gait, ed., 1984); "Animal Cell Culture" (R. I. Freshney, ed., 1987); "Methods in Enzymology" (Academic Press, Inc.); "Handbook of Experimental Immunology", $4^{th}$ edition (D. M. Weir & C. C. Blackwell, eds., Blackwell Science Inc., 1987); "Gene Transfer Vectors for Mammalian Cells" (J. M. Miller & M. P. Calos, eds., 1987); "Current Protocols in Molecular Biology" (F. M. Ausubel et al., eds., 1987); and "PCR: The Polymerase Chain Reaction", (Mullis et al., eds., 1994).

Methods of gene expression profiling include methods based on hybridization analysis of polynucleotides, methods based on sequencing of polynucleotides, and proteomics-based methods. Exemplary methods known in the art for the quantification of mRNA expression in a sample include northern blotting and in situ hybridization (Parker & Barnes, Methods in Molecular Biology 106:247-283 (1999)); RNAse protection assays (Hod, Biotechniques 13:852-854 (1992)); and PCR-based methods, such as reverse transcription PCT (RT-PCR) (Weis et al., Trends in Genetics 8:263-264 (1992)). Antibodies may be employed that can recognize sequence-specific duplexes, including DNA duplexes, RNA duplexes, and DNA-RNA hybrid duplexes or DNA-protein duplexes. Representative methods for sequencing-based gene expression analysis include Serial Analysis of Gene Expression (SAGE), and gene expression analysis by massively parallel signature sequencing (MPSS).

Reverse Transcriptase PCR (RT-PCR)

Typically, mRNA is isolated from a test sample. The starting material is typically total RNA isolated from a human tumor, usually from a primary tumor. Optionally, normal tissues from the same patient can be used as an internal control. mRNA can be extracted from a tissue sample, e.g., from a sample that is fresh, frozen (e.g. fresh frozen), or paraffin-embedded and fixed (e.g. formalin-fixed).

General methods for mRNA extraction are well known in the art and are disclosed in standard textbooks of molecular biology, including Ausubel et al., *Current Protocols of Molecular Biology*, John Wiley and Sons (1997). Methods for RNA extraction from paraffin embedded tissues are disclosed, for example, in Rupp and Locker, *Lab Invest.* 56:A67 (1987), and De Andrés et al., *BioTechniques* 18:42044 (1995). In particular, RNA isolation can be performed using a purification kit, buffer set and protease from commercial manufacturers, such as Qiagen, according to the manufacturer's instructions. For example, total RNA from cells in culture can be isolated using Qiagen RNeasy mini-columns. Other commercially available RNA isolation kits include MasterPure™ Complete DNA and RNA Purification Kit (EPICENTRE®, Madison, Wis.), and Paraffin Block RNA Isolation Kit (Ambion, Inc.). Total RNA from tissue samples can be isolated using RNA Stat-60 (Tel-Test). RNA prepared from tumor can be isolated, for example, by cesium chloride density gradient centrifugation.

The sample containing the RNA is then subjected to reverse transcription to produce cDNA from the RNA template, followed by exponential amplification in a PCR reaction. The two most commonly used reverse transcriptases are avilo myeloblastosis virus reverse transcriptase (AMV-RT) and Moloney murine leukemia virus reverse transcriptase (MMLV-RT). The reverse transcription step is typically primed using specific primers, random hexamers, or oligo-dT primers, depending on the circumstances and the goal of expression profiling. For example, extracted RNA can be reverse-transcribed using a GeneAmp RNA PCR kit (Perkin Elmer, Calif., USA), following the manufacturer's instructions. The derived cDNA can then be used as a template in the subsequent PCR reaction.

PCR-based methods use a thermostable DNA-dependent DNA polymerase, such as a Taq DNA polymerase. For example, TaqMan® PCR typically utilizes the 5'-nuclease activity of Taq or Tth polymerase to hydrolyze a hybridization probe bound to its target amplicon, but any enzyme with equivalent 5' nuclease activity can be used. Two oligonucleotide primers are used to generate an amplicon typical of a PCR reaction product. A third oligonucleotide, or probe, can be designed to facilitate detection of a nucleotide sequence of the amplicon located between the hybridization sites the two PCR primers. The probe can be detectably labeled, e.g., with a reporter dye, and can further be provided with both a fluorescent dye, and a quencher fluorescent dye, as in a Taqman® probe configuration. Where a Taqman® probe is used, during the amplification reaction, the Taq DNA polymerase enzyme cleaves the probe in a template-dependent manner. The resultant probe fragments disassociate in solution, and signal from the released reporter dye is free from the quenching effect of the second fluorophore. One molecule of reporter dye is liberated for each new molecule synthesized, and detection of the unquenched reporter dye provides the basis for quantitative interpretation of the data.

TaqMan® RT-PCR can be performed using commercially available equipment, such as, for example, ABI PRISM 7700™ Sequence Detection System™ (Perkin-Elmer-Applied Biosystems, Foster City, Calif., USA), or Lightcycler (Roche Molecular Biochemicals, Mannheim, Germany). In a preferred embodiment, the 5' nuclease procedure is run on a real-time quantitative PCR device such as the ABI PRISM 7700™ Sequence Detection System™. The system consists of a thermocycler, laser, charge-coupled device (CCD), camera and computer. The system amplifies samples in a 384-well format on a thermocycler. The RT-PCR may be performed in triplicate wells with an equivalent of 2 ng RNA input per 10 µL-reaction volume. During amplification, laser-induced fluorescent signal is collected in real-time through fiber optics cables for all wells, and detected at the CCD. The system includes software for running the instrument and for analyzing the data.

5'-Nuclease assay data are initially expressed as a threshold cycle ("$C_t$"). Fluorescence values are recorded during every cycle and represent the amount of product amplified to that point in the amplification reaction. The threshold cycle ($C_t$) is generally described as the point when the fluorescent signal is first recorded as statistically significant.

To minimize errors and the effect of sample-to-sample variation, RT-PCR is usually performed using an internal standard. The ideal internal standard gene (also referred to as a reference gene) is expressed at a constant level among cancerous and non-cancerous tissue of the same origin (i.e., a level that is not significantly different among normal and cancerous tissues), and is not significantly unaffected by the experimental treatment (i.e., does not exhibit a significant difference in expression level in the relevant tissue as a result of exposure to chemotherapy). For example, reference genes useful in the methods disclosed herein should not exhibit significantly different expression levels in cancerous colon as compared to normal colon tissue. RNAs most frequently used to normalize patterns of gene expression are mRNAs for the housekeeping genes glyceraldehyde-3-phosphate-dehydrogenase (GAPDH) and β-actin. Exemplary reference genes used for normalization comprise one or more of the following genes: ATP5E, GPX1, PGK1, UBB, and VDAC2. Gene expression measurements can be normalized relative to the mean of one or more (e.g., 2, 3, 4, 5, or more) reference genes. Reference-normalized expression measurements can range from 0 to 15, where a one unit increase generally reflects a 2-fold increase in RNA quantity.

Real time PCR is compatible both with quantitative competitive PCR, where internal competitor for each target sequence is used for normalization, and with quantitative comparative PCR using a normalization gene contained within the sample, or a housekeeping gene for RT-PCR. For further details see, e.g. Held et al., *Genome Research* 6:986-994 (1996).

The steps of a representative protocol for use in the methods of the present disclosure use fixed, paraffin-embedded tissues as the RNA source. mRNA isolation, purification, primer extension and amplification can be preformed according to methods available in the art. (see, e.g., Godfrey et al. J. Molec. Diagnostics 2: 84-91 (2000); Specht et al., Am. J. Pathol. 158: 419-29 (2001)). Briefly, a representative process starts with cutting about 10 µm thick sections of paraffin-embedded tumor tissue samples. The RNA is then extracted, and protein and DNA depleted from the RNA-containing sample. After analysis of the RNA concentration, RNA is reverse transcribed using gene specific primers followed by RT-PCR to provide for cDNA amplification products.

Design of Intron-Based PCR Primers and Probes

PCR primers and probes can be designed based upon exon or intron sequences present in the mRNA transcript of the gene of interest. Primer/probe design can be performed using publicly available software, such as the DNA BLAT software developed by Kent, W. J., Genome Res. 12(4):656-64 (2002), or by the BLAST software including its variations.

Where necessary or desired, repetitive sequences of the target sequence can be masked to mitigate non-specific signals. Exemplary tools to accomplish this include the Repeat Masker program available on-line through the Baylor College of Medicine, which screens DNA sequences against a library of repetitive elements and returns a query sequence in which the repetitive elements are masked. The masked intron sequences can then be used to design primer and probe sequences using any commercially or otherwise publicly available primer/probe design packages, such as Primer Express (Applied Biosystems); MGB assay-by-design (Applied Biosystems); Primer3 (Steve Rozen and Helen J. Skaletsky (2000) Primer3 on the WWW for general users and for biologist programmers. In: Rrawetz S, Misener S (eds) Bioinformatics Methods and Protocols: Methods in Molecular Biology. Humana Press, Totowa, N.J., pp 365-386).

Other factors that can influence PCR primer design include primer length, melting temperature (Tm), and G/C content, specificity, complementary primer sequences, and 3'-end sequence. In general, optimal PCR primers are generally 17-30 bases in length, and contain about 20-80%, such as, for example, about 50-60% G+C bases, and exhibit Tm's between 50 and 80° C., e.g. about 50 to 70° C.

For further guidelines for PCR primer and probe design see, e.g. Dieffenbach, C W. et al, "General Concepts for PCR Primer Design" in: PCR Primer, A Laboratory Manual, Cold Spring Harbor Laboratory Press, New York, 1995, pp. 133-155; Innis and Gelfand, "Optimization of PCRs" in: PCR Protocols, A Guide to Methods and Applications, CRC Press, London, 1994, pp. 5-11; and Plasterer, T. N. Primerselect: Primer and probe design. Methods MoI. Biol. 70:520-527 (1997), the entire disclosures of which are hereby expressly incorporated by reference.

Tables A and B provide further information concerning the primer, probe, and amplicon sequences associated with the Examples disclosed herein.

MassARRAY® System

In MassARRAY-based methods, such as the exemplary method developed by Sequenom, Inc. (San Diego, Calif.) following the isolation of RNA and reverse transcription, the obtained cDNA is spiked with a synthetic DNA molecule (competitor), which matches the targeted cDNA region in all positions, except a single base, and serves as an internal standard. The cDNA/competitor mixture is PCR amplified and is subjected to a post-PCR shrimp alkaline phosphatase (SAP) enzyme treatment, which results in the dephosphorylation of the remaining nucleotides. After inactivation of the alkaline phosphatase, the PCR products from the competitor and cDNA are subjected to primer extension, which generates distinct mass signals for the competitor- and cDNA-derives PCR products. After purification, these products are dispensed on a chip array, which is pre-loaded with components needed for analysis with matrix-assisted laser desorption ionization time-of-flight mass spectrometry (MALDI-TOF MS) analysis. The cDNA present in the reaction is then quantified by analyzing the ratios of the peak areas in the mass spectrum generated. For further details see, e.g. Ding and Cantor, Proc. Natl. Acad. Sci. USA 100:3059-3064 (2003).

Other PCR-Based Methods

Further PCR-based techniques that can find use in the methods disclosed herein include, for example, BeadArray® technology (Illumina, San Diego, Calif.; Oliphant et al., Discovery of Markers for Disease (Supplement to Biotechniques), June 2002; Ferguson et al., Analytical Chemistry 72:5618 (2000)); BeadsArray for Detection of Gene Expression® (BADGE), using the commercially available LuminexlOO LabMAP® system and multiple color-coded microspheres (Luminex Corp., Austin, Tex.) in a rapid assay for gene expression (Yang et al., Genome Res. 11:1888-1898 (2001)); and high coverage expression profiling (HiCEP) analysis (Fukumura et al., Nucl. Acids. Res. 31(16) e94 (2003).

Microarrays

Expression levels of a gene of interest can also be assessed using the microarray technique. In this method, polynucleotide sequences of interest (including cDNAs and oligonucleotides) are arrayed on a substrate. The arrayed sequences are then contacted under conditions suitable for specific hybridization with detectably labeled cDNA generated from mRNA of a test sample. As in the RT-PCR method, the source of mRNA typically is total RNA isolated from a tumor sample, and optionally from normal tissue of the same patient as an internal control or cell lines. mRNA can be extracted, for example, from frozen or archived paraffin-embedded and fixed (e.g. formalin-fixed) tissue samples.

For example, PCR amplified inserts of cDNA clones of a gene to be assayed are applied to a substrate in a dense array. Usually at least 10,000 nucleotide sequences are applied to the substrate. For example, the microarrayed genes, immobilized on the microchip at 10,000 elements each, are suitable for hybridization under stringent conditions. Fluorescently labeled cDNA probes may be generated through incorporation of fluorescent nucleotides by reverse transcription of RNA extracted from tissues of interest. Labeled cDNA probes applied to the chip hybridize with specificity to each spot of DNA on the array. After washing under stringent conditions to remove non-specifically bound probes, the chip is scanned by confocal laser microscopy or by another detection method, such as a CCD camera. Quantitation of hybridization of each arrayed element allows for assessment of corresponding mRNA abundance.

With dual color fluorescence, separately labeled cDNA probes generated from two sources of RNA are hybridized pair wise to the array. The relative abundance of the transcripts from the two sources corresponding to each specified gene is thus determined simultaneously. The miniaturized scale of the hybridization affords a convenient and rapid evaluation of the expression pattern for large numbers of genes. Such methods have been shown to have the sensitivity required to detect rare transcripts, which are expressed at a few copies per cell, and to reproducibly detect at least approximately two-fold differences in the expression levels (Schena et at, Proc. Natl. Acad. ScL USA 93(2):106-149 (1996)). Microarray analysis can be performed by commercially available equipment, following manufacturer's protocols, such as by using the Affymetrix GenChip® technology, or Incyte's microarray technology.

Serial Analysis of Gene Expression (SAGE)

Serial analysis of gene expression (SAGE) is a method that allows the simultaneous and quantitative analysis of a large number of gene transcripts, without the need of providing an individual hybridization probe for each transcript. First, a short sequence tag (about 10-14 bp) is generated that contains sufficient information to uniquely identify a transcript, provided that the tag is obtained from a unique position within each transcript. Then, many transcripts are linked together to form long serial molecules, that can be sequenced, revealing the identity of the multiple tags simultaneously. The expression pattern of any population of transcripts can be quantitatively evaluated by determining the abundance of individual tags, and identifying the gene corresponding to each tag. For more details see, e.g. Velculescu et al., Science 270:484-487 (1995); and Velculescu et al., Cell 88:243-51 (1997).

Gene Expression Analysis by Nucleic Acid Sequencing

Nucleic acid sequencing technologies are suitable methods for analysis of gene expression. The principle underlying these methods is that the number of times a cDNA sequence is detected in a sample is directly related to the relative expression of the mRNA corresponding to that sequence. These methods are sometimes referred to by the term Digital Gene Expression (DGE) to reflect the discrete numeric property of the resulting data. Early methods applying this principle were Serial Analysis of Gene Expression (SAGE) and Massively Parallel Signature Sequencing (MPSS). See, e.g., S. Brenner, et al., Nature Biotechnology 18(6):630-634 (2000). More recently, the advent of "next-generation" sequencing technologies has made DGE simpler, higher throughput, and more affordable. As a result, more laboratories are able to utilize DGE to screen the expression of more genes in more individual patient samples than previously possible. See, e.g., J. Marioni, Genome Research 18(9):1509-1517 (2008); R. Morin, Genome Research 18(4):610-621 (2008); A. Mortazavi, Nature Methods 5(7):621-628 (2008); N. Cloonan, Nature Methods 5(7):613-619 (2008).

Isolating RNA from Body Fluids

Methods of isolating RNA for expression analysis from blood, plasma and serum (See for example, Tsui N B et al. (2002) 48, 1647-53 and references cited therein) and from urine (See for example, Boom R et al. (1990) J Clin Microbiol. 28, 495-503 and reference cited therein) have been described.

Immunohistochemistry

Immunohistochemistry methods are also suitable for detecting the expression levels of genes and applied to the method disclosed herein. Antibodies (e.g., monoclonal antibodies) that specifically bind a gene product of a gene of interest can be used in such methods. The antibodies can be detected by direct labeling of the antibodies themselves, for example, with radioactive labels, fluorescent labels, hapten' labels such as, biotin, or an enzyme such as horse radish peroxidase or alkaline phosphatase. Alternatively, unlabeled primary antibody can be used in conjunction with a labeled secondary antibody specific for the primary antibody Immunohistochemistry protocols and kits are well known in the art and are commercially available.

Proteomics

The term "proteome" is defined as the totality of the proteins present in a sample (e.g. tissue, organism, or cell culture) at a certain point of time. Proteomics includes, among other things, study of the global changes of protein expression in a sample (also referred to as "expression proteomics"). Proteomics typically includes the following steps: (1) separation of individual proteins in a sample by 2-D gel electrophoresis (2-D PAGE); (2) identification of the individual proteins recovered from the gel, e.g. my mass spectrometry or N-terminal sequencing, and (3) analysis of the data using bioinformatics.

General Description of the mRNA Isolation, Purification and Amplification

The steps of a representative protocol for profiling gene expression using fixed, paraffin-embedded tissues as the RNA source, including mRNA isolation, purification, primer extension and amplification are provided in various published journal articles. (See, e.g., T. E. Godfrey et al., J. Molec. Diagnostics 2: 84-91 (2000); K. Specht et al., Am. J. Pathol. 158: 419-29 (2001), M. Cronin, et al., Am J Pathol 164:35-42 (2004)). Briefly, a representative process starts with cutting a tissue sample section (e.g. about 10 μm thick sections of a paraffin-embedded tumor tissue sample). The RNA is then extracted, and protein and DNA are removed. After analysis of the RNA concentration, RNA repair is performed if desired. The sample can then be subjected to analysis, e.g., by reverse transcribed using gene specific promoters followed by RT-PCR.

Statistical Analysis of Gene Expression Levels in Identification of Marker Genes for Use in Prognostic and/or Predictive Methods One skilled in the art will recognize that there are many statistical methods that may be used to determine whether there is a significant relationship between an outcome of interest (e.g., likelihood of survival, likelihood of response to chemotherapy) and expression levels of a marker gene as described here. This relationship can be presented as a continuous recurrence score (RS), or patients may stratified into risk groups (e.g., low, intermediate, high). For example, a Cox proportional hazards regression model may fit to a particular clinical endpoint (e.g., RFI, DFS, OS). One assumption of the Cox proportional hazards regression model is the proportional hazards assumption, i.e. the assumption that effect parameters multiply the underlying hazard. Assessments of model adequacy may be performed including, but not limited to, examination of the cumulative sum of martingale residuals. One skilled in the art would recognize that there are numerous statistical methods that may be used (e.g., Royston and Parmer (2002), smoothing spline, etc.) to fit a flexible parametric model using the hazard scale and the Weibull distribution with natural spline smoothing of the log cumulative hazards function, with effects for treatment (chemotherapy or observation) and RS allowed to be time-dependent. (See, P. Royston, M. Parmer, Statistics in Medicine 21(15:2175-2197 (2002).) The relationship between recurrence risk and (1) recurrence risk groups; and (2) clinical/pathologic covariates (e.g., number of nodes examined, pathological T stage, tumor grade, MSI status, lymphatic or vascular invasion, etc.) may also be tested for significance.

Many statistical methods may be used to determine if there is a significant interaction between expression levels of predictive genes and beneficial response to treatment ("treatment benefit"). For example, this relationship can be presented as a continuous treatment score (TS), or patients may stratified into benefit groups (e.g., low, intermediate, high). The interaction studied may vary, e.g. standard of care vs. new treatment, or surgery alone vs. surgery followed by chemotherapy. For example, a Cox proportional hazards regression could be used to model the follow-up data, i.e. censoring time to recurrence at a certain time (e.g., 3 years) after randomization for patients who have not experienced a recurrence before that time, to determine if the TS is associated with the magnitude of chemotherapy benefit. One might use the likelihood ratio test to compare the reduced model with RS, TS and the treatment main effect, with the full model that includes RS, TS, the treatment main effect, and the interaction of treatment and TS. A pre-determined p-value cut-off (e.g., p<0.05) may be used to determine significance.

Alternatively, the method of Royston and Parmer (2002) can be used to fit a flexible parametric model using the hazard scale and the Weibull distribution with natural spline smoothing of the log cumulative hazards function, with effects for treatment (chemotherapy or observation), RS, TS and the interaction of TS with treatment, allowing the effects of RS, TS and TS interaction with treatment to be time dependent. To assess relative chemotherapy benefit across the benefit groups, pre-specified cut-points for the RS and TS may be used to define low, intermediate, and high chemotherapy benefit groups. The relationship between treatment and (1) benefit groups; and (2) clinical/pathologic covariates may also be tested for significance. For example, one skilled in the art could identify significant trends in absolute chemotherapy benefit for recurrence at 3 years across the low, intermediate, and high chemotherapy benefit groups for surgery alone or surgery followed by chemotherapy groups. An absolute benefit of at least 3-6% in the high chemotherapy benefit group would be considered clinically significant.

In an exemplary embodiment, power calculations were carried for the Cox proportional hazards model with a single non-binary covariate using the method proposed by F. Hsieh and P. Lavori, Control Clin Trials 21:552-560 (2000) as implemented in PASS 2008.

Coexpression Analysis

The present disclosure provides genes that co-express with particular prognostic and/or predictive gene that has been identified as having a significant correlation to recurrence and/or treatment benefit. To perform particular biological processes, genes often work together in a concerted way, i.e. they are co-expressed. Co-expressed gene groups identified for a disease process like cancer can serve as biomarkers for disease progression and response to treatment. Such co-expressed genes can be assayed in lieu of, or in addition to, assaying of the prognostic and/or predictive gene with which they are co-expressed.

One skilled in the art will recognize that many co-expression analysis methods now known or later developed will fall within the scope and spirit of the present invention. These methods may incorporate, for example, correlation coefficients, co-expression network analysis, clique analysis, etc., and may be based on expression data from RT-PCR, microarrays, sequencing, and other similar technologies. For example, gene expression clusters can be identified using pair-wise analysis of correlation based on Pearson or Spearman correlation coefficients. (See, e.g., Pearson K. and Lee A., Biometrika 2, 357 (1902); C. Spearman, Amer. J. Psychol 15:72-101 (1904); J. Myers, A. Well, *Research Design and Statistical Analysis*, p. 508 ($2^{nd}$ Ed., 2003).) In general, a correlation coefficient of equal to or greater than 0.3 is considered to be statistically significant in a sample size of at least 20. (See, e.g., G. Norman, D. Streiner, Biostatistics: The Bare Essentials, 137-138 (3rd Ed. 2007).)

General Description of Exemplary Embodiments

This disclosure provides a method to determine a patient's likelihood of experiencing a cancer recurrence by assaying expression levels of certain prognostic genes from a tumor sample obtained from the patient. Such methods involve use of gene subsets that are created based on similar functions of gene products. For example, prognostic methods disclosed herein involve assaying expression levels of gene subsets that include at least one gene each from each of a stromal group and a cell cycle group, and calculating a recurrence score (RS) for the patient by weighting the expression levels of each of the gene subsets by their respective contributions to cancer recurrence. The weighting may be different for each gene subset, and may be either positive or negative. For example, the stromal group score could be weighted by multiplying by a factor of 0.15, the cell cycle group score by a factor of −0.3, the cell signaling group score by a factor of 0.15, and so on. Gene subsets in such prognostic methods can further include at least one gene from a cell signaling group, apoptosis group, or transcription factor group.

For example, the weights assigned to each gene subset in the exemplary embodiments is set forth below:

$$RS1 = W_s \times \text{Stromal Group Score} + W_a \times \text{Angiogenesis Group Score} - W_{cc} \times \text{Cell Cycle Group Score} + W_{cs} \times \text{Cell Signaling Group Score} - W_a \times \text{Apoptosis Group Score}$$

Where:
Stromal Group Score=(SG1+ . . . SGn)/n (SG=Stromal gene normalized expression level (NEL))
Cell Cycle Group Score=(CCG1+ . . . CCGn)/n (CCG=Cell cycle gene NEL)
Cell Signaling Group Score=(CSG1+ . . . CSGn) (CSG=Cell signaling gene NEL)
Apoptosis Group Score=(AG1+ . . . AGn)/n (AG=Apoptosis gene)
Angiogenesis Group Score=(AgG1+ . . . AgGn)/n (AgG=Angiogenesis gene)
$W_x$=weighting factor for each gene subset Alternatively, the genes within each gene subset may be weighted individually. Assuming standardized expression, the weights assigned to each gene subset in the exemplary embodiment is set forth below:

$$\text{Stromal Group Score}_2 = +BGN \text{ score} + FAP \text{ score} + INHBA \text{ score}$$

$$\text{Cell Cycle Group Score}_2 = -2[Ki\text{-}67 \text{ score} + MAD2L1 \text{ score} + 0.75(cMYC \text{ score}) + 0.25(MYBL2 \text{ score})]$$

$$\text{Apoptosis Group Score}_2 = -2(BIK \text{ score})$$

$$\text{Cell Signaling Group Score}_2 = +0.33(GADD45B \text{ score})$$

$$\text{Angiogenesis Group Score}_2 = +EFNB2 \text{ score}$$

To translate the RS2 model into non-standardized expression, the weights may be divided by gene standard deviation. For example, assuming non-standardized expression, the weights assigned to each gene subset in the exemplary embodiment is set forth below:

$$\text{Stromal Group Score}_{ns} = +1.06(BGN \text{ score}) + 1.38(FAP \text{ score}) + 1.14(INHBA \text{ score})$$

$$\text{Angiogenesis Group Score}_{ns} = +1.34(EFNB2)$$

$$\text{Cell Signaling Group Score}_{ns} = +0.44 GADD45B$$

$$\text{Cell Cycle Group Score}_{ns} = -2[1.85(Ki\text{-}67 \text{ score}) + 1.32(MAD2L1 + 0.83(cMYC \text{ score}) + 0.45(MYBL2 \text{ score})]$$

$$\text{Apoptosis Group Score}_{ns} = -2(BIK \text{ score})$$

In exemplary embodiments, RS is calculated using expression levels of one or more of BGN, FAP, INHBA, EFNB2, MYBL2, Ki-67, cMYC, MAD2L1, HSPE1, GADD45B, BIK, and RUNX1. The disclosure provides substitute prognostic genes, the expression levels of which may similarly be used to calculate RS. These substitute predictive genes include genes that co-express with BGN, FAP, INHBA, EFNB2, MYBL2, Ki-67, cMYC, MAD2L1, HSPE1, GADD45B, BIK, or RUNX1

The $RS_u$ (recurrence score unscaled) may be rescaled, for example to be between 0 and 100. More particularly, the $RS_u$ may be rescaled as follows:

$$RS = \begin{cases} 0 & \text{if } 44 \times (RS_U + 0.82) < 0 \\ 44 \times (RS_U + 0.82) & \text{if } 0 \leq 44 \times (RS_U + 0.82) \leq 100 \\ 100 & \text{if } 44 \times (RS_U + 0.82) > 100 \end{cases}$$

The RS may be used to determine a recurrence risk group for each patient. For example, recurrence scores may be divided into three risk classification groups using predefined cut-points. The cut-points between the low, intermediate, and high recurrence risk groups may be defined, for example, as in Table 1.

TABLE 1

Recurrence Risk Stratification

| Recurrence Risk Group | Recurrence Score |
|---|---|
| Low risk of recurrence | Less than 30 |
| Intermediate risk of recurrence | Greater than or equal to 30 and less than 41 |
| High risk of recurrence | Greater than or equal to 41 |

The RS may be rounded to the nearest integer before the cut-points defining recurrence risk groups are applied.

The disclosure also provides methods to determine the likelihood that a patient with colorectal cancer will have a beneficial response to chemotherapy including assaying expression levels of predictive genes, where the expression levels are used in an algorithm based on gene subsets that include at least one gene each from a growth factor receptor group, an apoptosis group, and a MSI group, and calculating a treatment score (TS) for the patient by weighting the expression levels of each of the gene subsets by their respective contributions to response to chemotherapy. The weighting may be different for each gene subset, and may be either positive or negative. For example, the stromal group could be weighted by multiplying by a factor of −0.3, the transcription factor by a factor of −0.04, the apoptosis group by a factor of 0.3, the cell cycle group by a factor of 0.1, and the MSI group by a factor of 0.1. The gene subsets may additionally comprise at least one gene from a transcription factor group and/or a cell cycle group.

In the exemplary embodiments, the weights assigned to each gene subset is set forth below:

$TS = -W_s \times$ Stromal Group Score $-W_{tf} \times$ Transcription Factor Group Score $+W_a \times$ Apoptosis Group Score $+W_{cc} \times$ Cell Cycle Group Score $+W_{msi} \times$ MSI Group Score Where:
  Stromal Group Score=(SG1+ . . . SGn) (SG=stromal gene normalized expression level (NEL))
  Transcription Factor Group Score=(TFG1+ . . . TFGn) (TFG=transcription factor gene NEL)
  Apoptosis Group Score=(AG1+ . . . AGn) (AG=apoptosis gene NEL)
  Cell Cycle Group Score=(CCG1+ . . . CCGn) (CCG=cell cycle gene NEL)
  MSI Group Score=(MG1+ . . . MGn) (MG=MSI gene NEL)
  $W_x$=weighting factor for each gene subset In exemplary embodiments, TS is calculated using expression levels for AXIN2, BIK, EFNB2, HSPE1, MAD2L1, and RUNX1.

The disclosure provides other predictive genes, the expression levels of which may similarly be used to calculate a TS. These substitute predictive genes include RANBP2, BUB1, TOP2A, C20_ORF1, CENPF, STK15, AURKB, HIF1A, UBE2C, and MSH2, and gene that co-express with said substitute predictive genes with a Pearson correlation co-efficient of at least 0.60.

The $TS_u$ (Treatment Score unsealed) may be rescaled, for example it may be rescaled to be between 0 and 100. More particularly, $TS_u$ may be rescaled as follows:

$$TS = \begin{cases} 0 & \text{if } 37 \times (TS_U - 1) < 0 \\ 37 \times (TS_U - 1) & \text{if } 0 \leq 37 \times (TS_U - 1) \leq 100 \\ 100 & \text{if } 37 \times (TS_U - 1) > 100 \end{cases}$$

In addition, the TS may be used to determine a "benefit score" for each patient. For example, the patient may be classified as one who is expected to have a low, medium, or high benefit from chemotherapy. In a particular example, the RS, TS, and predefined cut-points can be used to determine a benefit score for each patient. The low, intermediate, and high benefit scores or groups may be defined as in Table 2.

TABLE 2

Beneficial Response to Chemotherapy Stratification

| Benefit Group | $X = 0.859^{exp[1.839 \times RS_u + 3.526 - 1.781 \times TS_u]} - 0.859^{exp[1.839 \times RS_u]}$ |
|---|---|
| Low Benefit | X less than 2% |
| Intermediate Benefit | X greater than or equal to 2% and less than 6% |
| High Benefit | X greater than or equal to 6% |

Data Aggregation

The expression data may be aggregated. The purpose of data aggregation is to combine information across replicate qRT-PCR wells for individual genes. For example, during qRT-PCR, triplicate wells may be run for each gene and sample. Valid triplicate wells for each gene may be aggregated into a single weighted average $C_t$ value. The resulting weighted average $C_t$ effectively down weights the influence of outlier observations. The data aggregation module may include the following steps for each gene and sample:
  (1) Retrieve calculated $C_t$ values and status data.
  (2) Aggregate plate level statistics and record module version, date and time of processing.
  (3) Aggregate $C_t$ values for each gene and store statistics using all wells (valid and invalid).
  (4) Compute gene validity based on the number of valid wells.
  (5) Compute the weighted average of the valid wells for each gene.

Normalization of Expression Levels

The expression data used in the methods disclosed herein can be normalized. Normalization refers to a process to correct for (normalize away), for example, differences in the amount of RNA assayed and variability in the quality of the RNA used, to remove unwanted sources of systematic variation in $C_t$ measurements, and the like. With respect to RT-PCR experiments involving archived fixed paraffin embedded tissue samples, sources of systematic variation are known to include the degree of RNA degradation relative to the age of the patient sample and the type of fixative used to store the sample. Other sources of systematic variation are attributable to laboratory processing conditions.

Assays can provide for normalization by incorporating the expression of certain normalizing genes, which genes do not significantly differ in expression levels under the relevant conditions. Exemplary normalization genes include housekeeping genes such as PGK1 and UBB. (See, e.g., E. Eisenberg, et al., Trends in Genetics 19(7):362-365 (2003).) Normalization can be based on the mean or median signal ($C_T$) of all of the assayed genes or a large subset thereof (global normalization approach). In general, the normalizing genes, also referred to as reference genes should be genes that are known not to exhibit significantly different expression in colorectal cancer as compared to non-cancerous colorectal tissue, and are not significantly affected by various sample and process conditions, thus provide for normalizing away extraneous effects.

Unless noted otherwise, normalized expression levels for each mRNA/tested tumor/patient will be expressed as a percentage of the expression level measured in the reference set. A reference set of a sufficiently high number (e.g. 40) of tumors yields a distribution of normalized levels of each mRNA species. The level measured in a particular tumor sample to be analyzed falls at some percentile within this range, which can be determined by methods well known in the art.

In exemplary embodiments, one or more of the following genes are used as references by which the expression data is normalized: ATP5E, GPX1, PGK1, UBB, and VDAC2. The calibrated weighted average $C_t$ measurements for each of the prognostic and predictive genes may be normalized relative to the mean of five or more reference genes.

Those skilled in the art will recognize that normalization may be achieved in numerous ways, and the techniques described above are intended only to be exemplary, not exhaustive.

Bridging Expression Measurements and Calibration

An oligonucleotide set represents a forward primer, reverse primer, and probe that are used to build a primer and probe (P3) pool and gene specific primer (GSP) pool. Systematic differences in RT-PCR cycle threshold (Ct) measurements can result between different oligonucleotide sets due to inherent variations oligonucleotide syntheses. For example, differences in oligonucleotide sets may exist between development, production (used for validation), and future production nucleotide sets. Thus, use of statistical calibration procedures to adjust for systematic differences in oligonucleotide sets resulting in translation in the gene coefficients used in calculating RS and TS may be desirable. For example, for each of the genes assayed for use in an algorithm, one may use a scatterplot of $C_t$ measurements for production oligonucleotide sets versus $C_t$ measurements from a corresponding sample used in different oligonucleotide set to create linear regression model that treats the effect of lot-to-lot differences as a random effect. Examination of such a plot will reveal that the variance of $C_t$ measurements increases exponentially as a function of the mean $C_t$. The random effects linear regression model can be evaluated with log-linear variance, to obtain a linear calibration equation. A calculated mean squared error (MSE) for the scores can be compared to the MSE if no calibration scheme is used at all.

As another example, a latent variable measurement of $C_t$ (e.g. first principle component) may be derived from various oligonucleotide sets. The latent variable is a reasonable measure of the "true" underlying $C_t$ measurement. Similar to the method described above, a linear regression model may be fit to the sample pairs treating the effects of differences as a random effect, and the weighted average $C_t$ value adjusted to a calibrated $C_t$.

Centering and Data Compression/Scaling

Systematic differences in the distribution of patient RS and TS due to analytical or sample differences may exist between early development, clinical validation and commercial samples. A constant centering tuning parameter may be used in the algorithm to account for such difference.

Data compression is a procedure used to reduce the variability in observed normalized $C_t$ values beyond the limit of quantitation (LOQ) of the assay. Specifically, for each of the colon cancer assay genes, variance in $C_t$ measurements increase exponentially as the normalized $C_t$ for a gene extends beyond the LOQ of the assay. To reduce such variation, normalized $C_t$ values for each gene may be compressed towards the LOQ of the assay. Additionally, normalized $C_t$ values may be rescaled. For example, normalized $C_t$ values of the prognostic, predictive, and reference genes may be rescaled to a range of 0 to 15, where a one-unit increase generally reflects a 2-fold increase in RNA quantity.

Threshold Values

The present invention describes a method to determine a threshold value for expression of a cancer-related gene, comprising measuring an expression level of a gene, or its expression product, in a tumor section obtained from a cancer patient, normalizing the expression level to obtain a normalized expression level, calculating a threshold value for the normalized expression level, and determining a score based on the likelihood of recurrence or clinically beneficial response to treatment, wherein if the normalized expression level is less than the threshold value, the threshold value is used to determine the score, and wherein if the normalized expression level is greater or equal to the threshold value, the normalized expression level is used to determine the score.

For example, a threshold value for each cancer-related gene may be determined through examination of the functional form of relationship between gene expression and outcome. Examples of such analyses are presented for Cox PH regression on recurrence free interval where gene expression is modeled using natural splines and for logistic regression on recurrence status where gene expression is modeled using lowess smoother.—(See, e.g., FIGS. 6-10.)

Thresholded $C_t$ values for each prognostic, predictive, and reference genes can be used to calculate RS and TS. Exemplary thresholded $C_t$ values for the 18-gene assay described herein are set forth in Table 3.

TABLE 3

Gene expression panel and threshold values

| Gene | Accession Number | Threshold | Gene | Accession Number | Threshold |
|---|---|---|---|---|---|
| ATP5E | NM_006886 | None | MYBL2 | NM_002466 | 6 |
| GPX1 | NM_000581 | None | Ki-67 | NM_002417 | 6 |
| PGK1 | NM_000291 | None | GADD45B | NM_015675 | 4.5 |
| UBB | NM_018955 | None | EFNB2 | NM_004093 | 4 |
| VDAC2 | NM_003375 | None | RUNX1 | NM_001754 | 4.5 |
| BGN | NM_001711 | None | BIK | NM_001197 | 4.5 |
| FAP | NM_004460 | 6 | MAD2L1 | NM_002358 | 3 |
| INHBA | NM_002192 | None | HSPE1 | NM_002157 | None |
| cMYC | NM_002467 | None | AXIN2 | NM_004655 | None |

Thresholded $C_t$ values for each gene are calculated according to the formula:

$$\begin{cases} \text{if Normalized } C_T < \text{Threshold} & \text{Threshold } C_T = \text{Threshold} \\ \text{if Normalized } C_T \geq \text{Threshold} & \text{Threshold } C_T = \text{Normalized } C_T \end{cases}$$

It will be appreciated by one of ordinary skill in the art that a purpose of thresholding is to address non-linear functional forms for gene expression measurements. However, it will be readily appreciated that other nonlinear transforms other than thresholding can be used to accomplish the same effect.

Building Gene Cliques from Validated Biomarkers

This disclosure contemplates using co-expressed genes and/or gene cliques, identified with respect to prognostic and/or predictive genes, as substitutes for, or for analysis with, the prognostic and/or predictive genes disclosed herein. One method disclosed to analyze gene cliques that co-express with a target gene (i.e., a gene of interest) involves normalizing microarray gene expression data for cancer tumor samples based on array probes, calculating a correlation coefficient (e.g., using Spearman or Pearson correlation coefficients) based on gene expression levels for every unique pair of array probes, determining significant probe pairs, wherein significant probe pairs are a target gene probe and an array probe with a correlation co-efficient greater than a significant threshold value (e.g., a Spearman correlation co-efficient ≥0.5), mapping the target gene to its corresponding target gene probe, selecting a candidate probe set, wherein each candidate probe is part of a significant probe pair, and identifying an official gene symbol for each candidate probe (e.g., Entrez Gene Symbol). For example, Table 6 lists the gene cliques associated with FAP, INHBA, Ki-67, HSPE1, MAD2L1, and RUNX1.

Kits of the Invention

The materials for use in the methods of the present invention are suited for preparation of kits produced in accordance with well known procedures. The present disclosure thus provides kits comprising agents, which may include gene-specific or gene-selective probes and/or primers, for quantitating the expression of the disclosed genes for predicting prognostic outcome or response to treatment. Such kits may optionally contain reagents for the extraction of RNA from tumor samples, in particular fixed paraffin-embedded tissue samples and/or reagents for RNA amplification. In addition, the kits may optionally comprise the reagent(s) with an identifying description or label or instructions relating to their use in the methods of the present invention. The kits may comprise containers (including microliter plates suitable for use in an automated implementation of the method), each with one or more of the various reagents (typically in concentrated form) utilized in the methods, including, for example, pre-fabricated microarrays, buffers, the appropriate nucleotide triphosphates (e.g., dATP, dCTP, dGTP and dTTP; or rATP, rCTP, rGTP and UTP), reverse transcriptase, DNA polymerase, RNA polymerase, and one or more probes and primers of the present invention (e.g., appropriate length poly(T) or random primers linked to a promoter reactive with the RNA polymerase). Mathematical algorithms used to estimate or quantify prognostic or predictive information are also properly potential components of kits.

Reports

The methods of this invention, when practiced for commercial diagnostic purposes, generally produce a report or summary of information obtained from the herein-described methods. For example, a report may include information concerning expression levels of prognostic and/or predictive genes, a prediction of the predicted clinical outcome or response to chemotherapy for a particular patient, or gene cliques or thresholds. The methods and reports of this invention can further include storing the report in a database. The method can create a record in a database for the subject and populate the record with data. The report may be a paper report, an auditory report, or an electronic record. The report may be displayed and/or stored on a computing device (e.g., handheld device, desktop computer, smart device, website, etc.). It is contemplated that the report is provided to a physician and/or the patient. The receiving of the report can further include establishing a network connection to a server computer that includes the data and report and requesting the data and report from the server computer.

Computer Program

The values from the assays described above, such as expression data, recurrence score, treatment score and/or benefit score, can be calculated and stored manually. Alternatively, the above-described steps can be completely or partially performed by a computer program product. The present invention thus provides a computer program product including a computer readable storage medium having a computer program stored on it. The program can, when read by a computer, execute relevant calculations based on values obtained from analysis of one or more biological sample from an individual (e.g., gene expression levels, normalization, thresholding, and conversion of values from assays to a score and/or graphical depiction of likelihood of recurrence/response to chemotherapy, gene co-expression or clique analysis, and the like). The computer program product has stored therein a computer program for performing the calculation.

The present disclosure provides systems for executing the program described above, which system generally includes: a) a central computing environment; b) an input device, operatively connected to the computing environment, to receive patient data, wherein the patient data can include, for example, expression level or other value obtained from an assay using a biological sample from the patient, or microarray data, as described in detail above; c) an output device, connected to the computing environment, to provide information to a user (e.g., medical personnel); and d) an algorithm executed by the central computing environment (e.g., a processor), where the algorithm is executed based on the data received by the input device, and wherein the algorithm calculates a RS, TS, risk or benefit group classification, gene co-expression analysis, thresholding, or other functions described herein. The methods provided by the present invention may also be automated in whole or in part.

All aspects of the present invention may also be practiced such that a limited number of additional genes that are co-expressed with the disclosed genes, for example as evidenced by statistically meaningful Pearson and/or Spearman correlation coefficients, are included in a prognostic or predictive test in addition to and/or in place of disclosed genes.

Having described the invention, the same will be more readily understood through reference to the following Examples, which are provided by way of illustration, and are not intended to limit the invention in any way.

EXAMPLE 1

Gene Expression Analysis for Colon Cancer Recurrence

Methods and Materials:
Patients and Samples

Tumor tissue samples were from two cohorts of patients with stage II or stage III colon cancer treated with surgery alone form the basis for this report. Further details concerning the NSABP protocols C-01, C-02, C-03, and C-04 are available in C. Allegra, J Clin Oncology 21(2):241-250 (2003) and related U.S. application Ser. Nos. 11/653,102 and 12/075,813, the contents of which are incorporated herein by reference.

The first cohort pooled available patient samples from NSABP protocols C-01 or C-02 in which patients were randomly assigned to receive either colon resection alone or resection+*bacillus* Calmette-Guerin ("BCG") immunotherapy. The second cohort (CCF) included stage II and stage III colon cancer patients treated with surgery alone at CCF between the years 1981 and 2000. None of the patients in either group received adjuvant chemotherapy. In both cohorts, gene expression measurements were obtained from archived, formalin-fixed, paraffin-embedded (FPE) colon tumor tissue.

Differential Expression Data:

The final number of evaluable FPE blocks was 270 in the NSABP cohort and 765 in the CCF cohort (n=1035). The primary reasons for exclusion were failure to meet minimum RNA yield (10% of samples in NSABP and 8% in CCF) and failure to meet quality control criteria for RT-qPCR (7% in NSABP and 2% in CCF).

The primary analysis in both studies investigated the relationship between the expression of 761 genes and RFI. This analysis identified sixty-five genes were found to be nominally significant in both studies. (See FIG. 1.) The high level of agreement was observed between the univariate hazard ratios for 63 (97%) of 65 genes significantly related to RFI in both studies. Of the genes found to be significantly related to RFI in either study, the majority were also related to both DFS and OS within the same study.

In both cohorts, the relationship between the expression of each gene and RFI was investigated, controlling for study and baseline characteristics. Any of the baseline clinical characteristics or study design attributes that had at least a modest association (p<0.2) with RFI were included in the multivariate analysis. Sixty-one (43%) of the 143 genes significant in univariate analyses in the NSABP cohort were statistically significant after controlling for nodal status, tumor location, tumor grade, mucinous tumor type, study protocol (C-01 vs. C-02), treatment assignment (BCG vs. none), and year of surgery. Eighty-eight (74%) of the 119 genes significant in univariate analysis in the CCF cohort retained significance after adjustment for age, nodal status, number of lymph nodes examined, tumor grade, mucinous tumor type, fixative, surgery year and T stage. There was agreement between the multivariate hazard ratios for the 65 genes significantly related to RFI in both studies. The hazard ratios were concordant for 63 of 65 genes. The consistency of hazard ratio estimates from the uni- and multivariate Cox regression analyses indicates that expression levels of these genes provide prognostic information which is relatively independent of traditional clinical predictors.

These 65 genes represent pathways that would be expected to be important in colon cancer recurrence. To identify genes that were co-expressed and therefore possibly members of the same functional gene family, hierarchical cluster analysis and forest plots were created using the genes that were significantly related to RFI in that study (not shown) as well as for the genes significantly related to RFI in both studies. Cluster analysis identified that the majority (48) of the prognostic genes fell into two relatively distinct gene groups: a stromal gene group (containing several subgroups) and a cell cycle gene group. The stromal group contained genes which, when highly expressed, were associated with a worse outcome and increased likelihood of recurrence, such as BGN, FAP, INHBA, and EFNB2. The cell cycle group contained genes which, when highly expressed, were associated with a better outcome and decreased likelihood of recurrence, such as cMYC, MYBL2, Ki-67, MAD2L1, and HSPE1.

EXAMPLE 2

Gene Expression Analysis for Prognostic and Predictive Genes

A study was conducted to assay gene expression levels in tumor samples obtained from patients with stage II or III colon cancer treated with surgery and 5FU/LV and perform analysis across four independent studies to identify genes that quantitate both the individual risk of recurrence in patients treated with surgery alone (prognosis) and the individual treatment benefit of 5-FU/LV adjuvant chemotherapy (prediction). Further information about these studies can be found in related U.S. application Ser. Nos. 11/653, 102 and 12/075,813, the contents of which are incorporated herein by reference.

Methods and Materials

Patients and Samples

Tissue samples were obtained from two cohorts of patients with stage II or stage III colon cancer treated with surgery and 5FU/LV. The first cohort included available patient samples from the 5FU/LV arm of NSABP Study C-04 in which patients were randomly assigned to receive either 5FU/LV, 5FU+levamisole or 5FU/LV+levamisole. (See, N. Wolmark, et al., J Clin Oncol 17:3553-3559 (1999). The second cohort included available patient samples from the 5FU/LV arm of NSABP Study C-06 in which patients were randomly assigned to receive 5FU/LV or oral uracil/tegafur plus leucovorin. (See, B. Lembersky, et al., J Clin Oncol 24:2059-2064 (2006). The 5FU/LV regimen was the same in both studies. In both cohorts, gene expression measurements were obtained from archived, formalin-fixed, paraffin-embedded (FPE) colon tumor tissue.

Based on treatment assignment and eligibility in the original NSABP studies, 691 C-04 patients and 792 C-06 patients qualified for this study. Available formalin-fixed paraffin-embedded (FPE) blocks for patients enrolled in C-04 (n=360) and C-06 (n=573) were assayed. After applying pre-specified exclusion criteria, the final number of evaluable patients was 308 in the C-04 cohort and 508 in the C-06 cohort. The primary reasons for exclusion were failure to satisfy pathology requirements (8.6% in C-04 and 1.7% in C-06) and failure to meet clinical eligibility criteria (1.7% in C-04 and 7.5% in C-06).

Analysis Methods

The primary analysis in both studies investigated the relationship between the expression of each gene and RFI. This analysis identified 143 (19%) of the 761 genes as being significantly related to RFI in the C-04 cohort compared to 169 (45%) of the 375 genes in the C-06 cohort. Seventy-five genes were found to be nominally significant in both studies. The hazard ratios were concordant (i.e. in similar direction) for 73 (97%) of these 75 genes. Of the genes found to be significantly related to RFI in either study, the majority were also related to both DFS and OS within the same study. Seventy-one (50%) of 143 genes significantly associated with RFI in univariate analyses in the C-04 study were statistically significant after controlling for nodal status and age. One hundred thirty-seven (81%) of the 169 genes significant in univariate analyses in the C-06 study were statistically significant after controlling for nodal involvement and mucinous tumor type. A high level of agreement between the univariate and multivariate hazard ratios for genes significantly related to RFI in both studies was observed.

Figure 2:
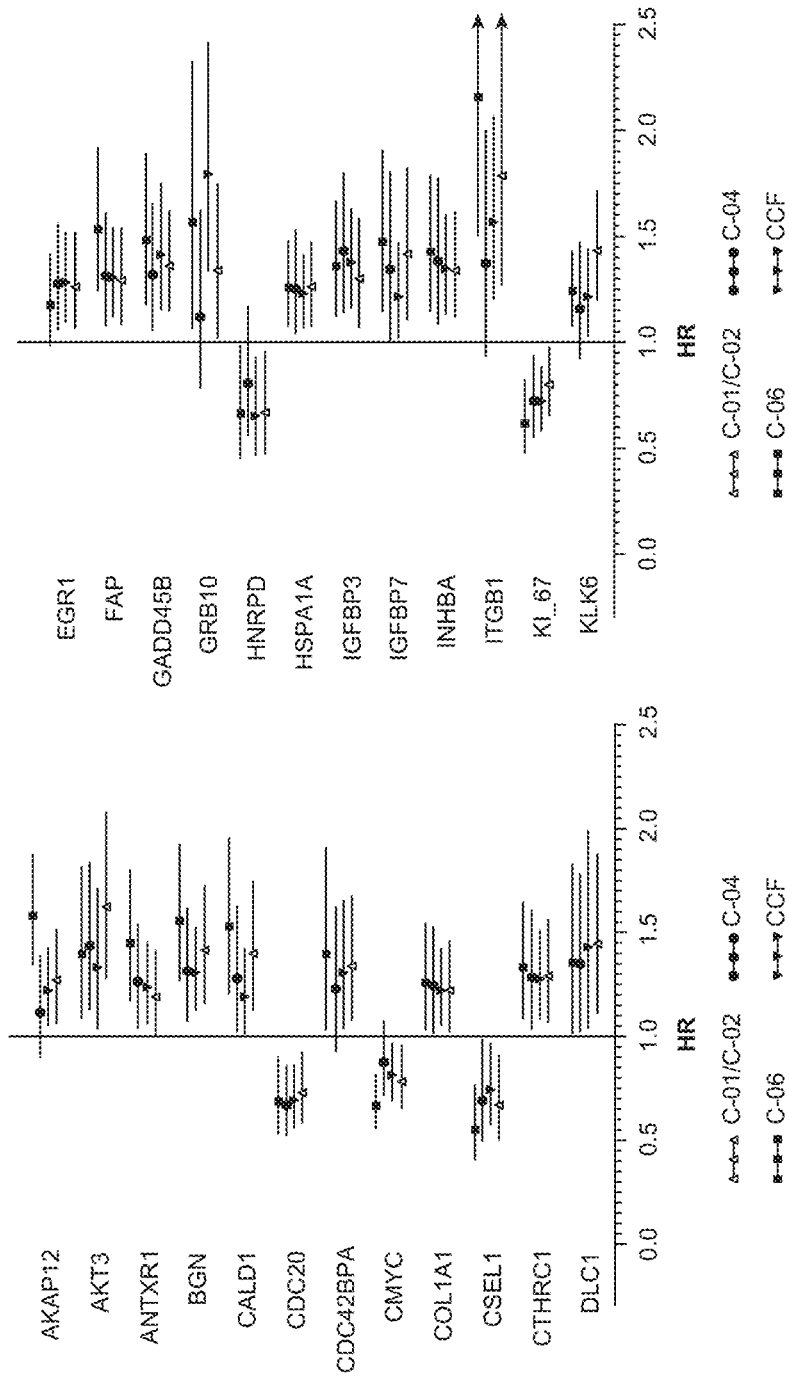
FIG. 2 is a series of graphs providing hazard ratio estimates and 95% confidence intervals for gene expression from univariate Cox PH regression models of RFI in C-01/02/04/06 and CCF patients for 48 gene significantly related to RFI in both surgery only and surgery plus FU-based chemotherapy.
Figure 2:
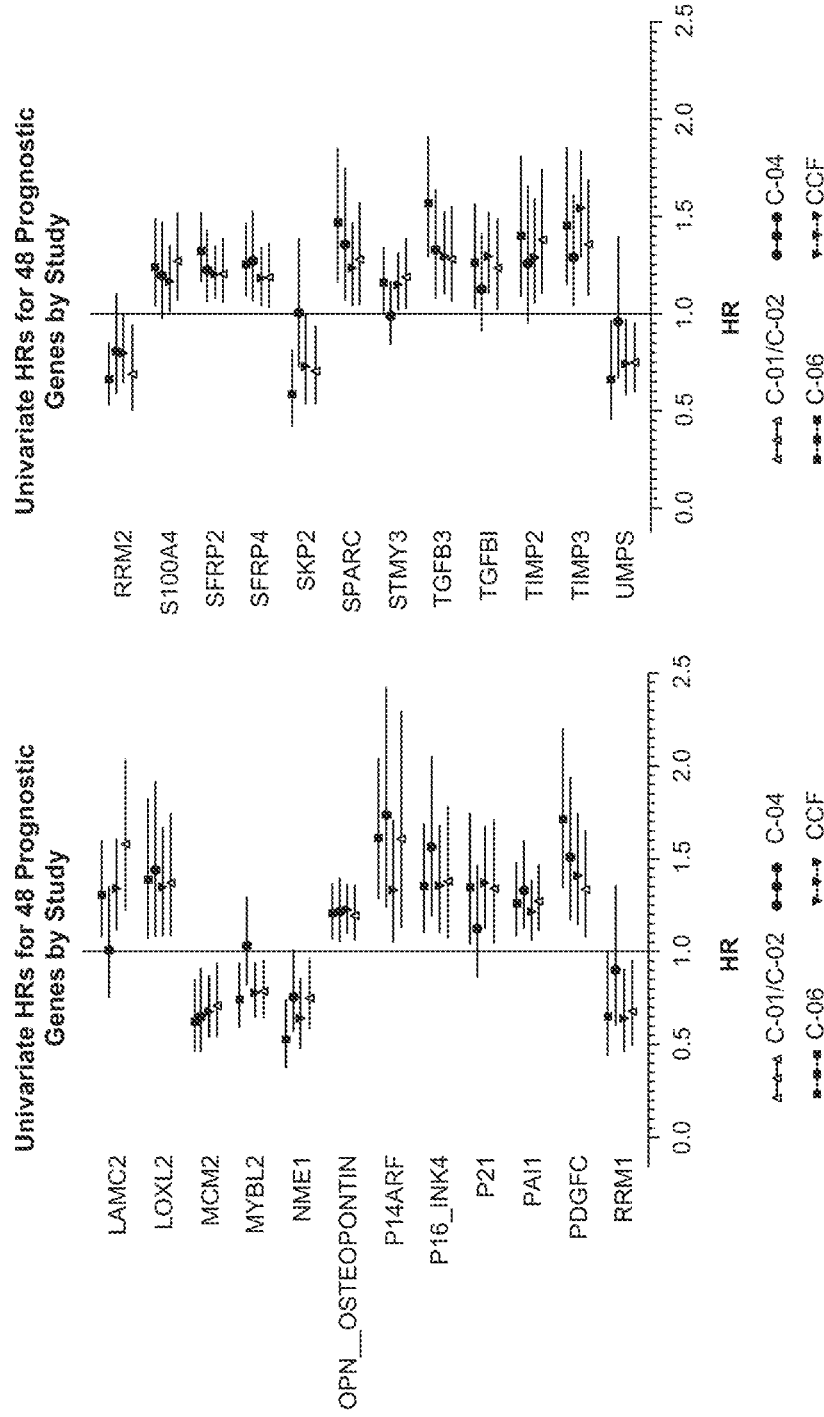

To identify prognostic genes across the four colon development studies, the focus was on the genes which significantly and consistently associated with RFI in both surgery only (C-01/C-02 and CCF studies described in Example 1) and surgery+5FU/LV-treated (C-04 and C-06) patients since prognostic genes are expected to have a similar relationship (i.e. similar direction and magnitude of the HR's) with outcome when measured in patients treated with the standard of care or in patients treated with a new intervention. A total of 48 (13%) of 375 genes studied in all four development studies were significantly (p<0.05) associated with RFI in both surgery only studies and at least one surgery+5FU/LV study. Due to type II error considerations, genes were not required to be significant in all four studies. The univariate hazard ratios and associated confidence intervals for the 48 genes in each of the four colon development studies are presented in FIG. 2. Cluster analysis identified two relatively distinct gene groups among the 48 prognostic genes: a stromal activation gene group (containing several subgroups) and a cell cycle gene group. The stromal group contained genes which, when highly expressed, were associated with a worse outcome and increased likelihood of recurrence, such as BGN, FAP, INHBA, and EFNB2. The cell cycle group contained genes which, when highly expressed, were associated with a better outcome and decreased likelihood of recurrence, such as cMYC, MYBL2, Ki-67, MAD2L1, and HSPE1.

In contrast to prognostic genes, the predictive genes are expected to exhibit a different relationship with outcome (i.e. different HR's) in patients treated with surgery only as compared to patients treated with surgery+5FU/LV. To identify predictive genes, multivariate Cox proportional hazards models were examined, including main effects of gene and treatment and an interaction of gene and treatment for each of the 375 genes pooling the data across the four colon development studies. A total of 66 (18%) of 375 genes studied in all four development studies had an interaction of gene expression and treatment significant at 0.10 level. Only 4 of these 66 genes had significant association with RFI in the two independent surgery alone studies and at least one of the surgery+5 FU/LV study (i.e. were included in the set of 48 prognostic genes), indicating that a small minority of predictive genes are both prognostic and predictive. Fifty-nine of the 66 genes were not associated with RFI in both surgery only studies, indicating that the majority of predictive genes are not also prognostic genes.

These 66 genes represent pathways that would be expected to be important in response to chemotherapy. Cluster analysis identified two relatively distinct gene groups among 66 potentially predictive genes. One group contains a large number of cell cycle related genes such as centromere and spindle associated proteins (CENPA, KIFC1, KIF22, STK15, MAD2L1, AURKB), checkpoint regulation (CDC2, BUB1), and a DNA topoisomerase (TOP2A). The second group contains genes which represent several different biological pathways, including a tight group of stromal activation genes (BGN, SPARC, COL1A1, CDH11, MMP2, and TIMP1), and genes associated with apoptosis (BIK), 5FU metabolism (UPP), and B-catenin/wnt signaling (AXIN2, LEF). It is of note that the two mismatch repair genes (MSH2 and MSH3) and several hypoxia/stress response genes (NR4A1, RhoB, HIF1A, CREBBP, PKR2, EPAS1) were also associated with response to 5-FU/LV chemotherapy.

Figure 3A:
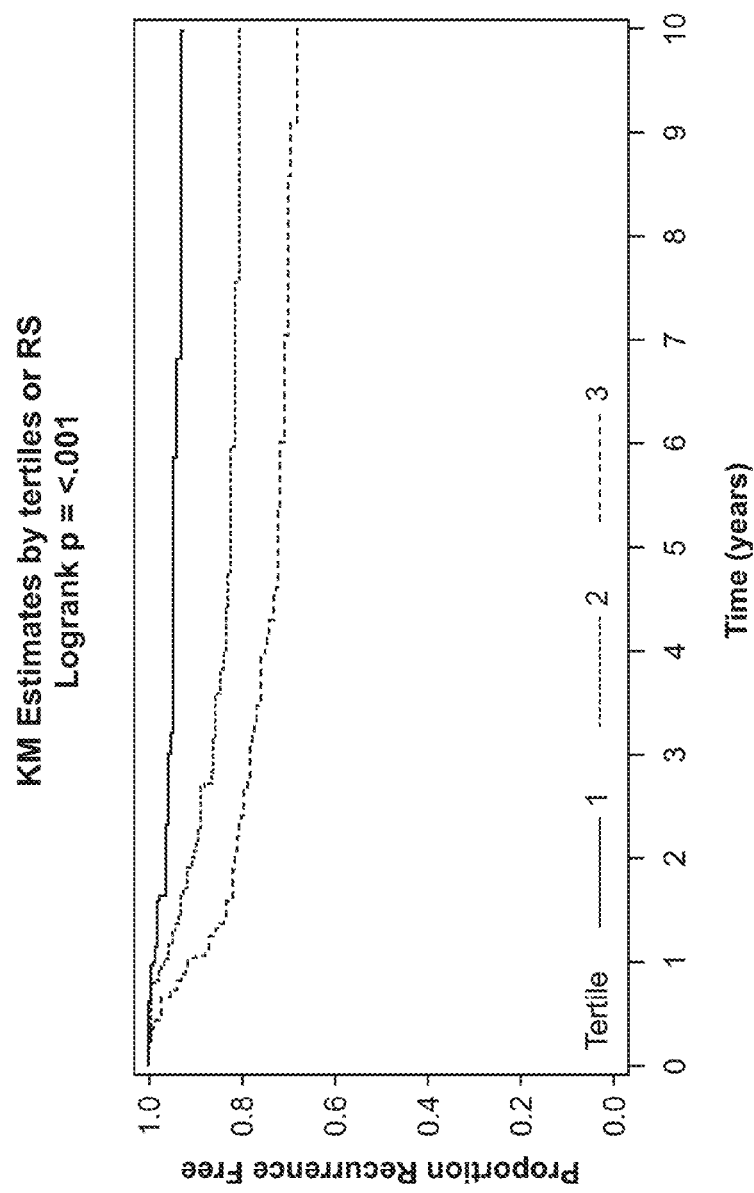
FIG. 3a is a graph illustrating Kaplan-Meier estimates of recurrence-free interval Stage II patients treated with surgery only, by tertile of recurrence score.
Figure 4A:
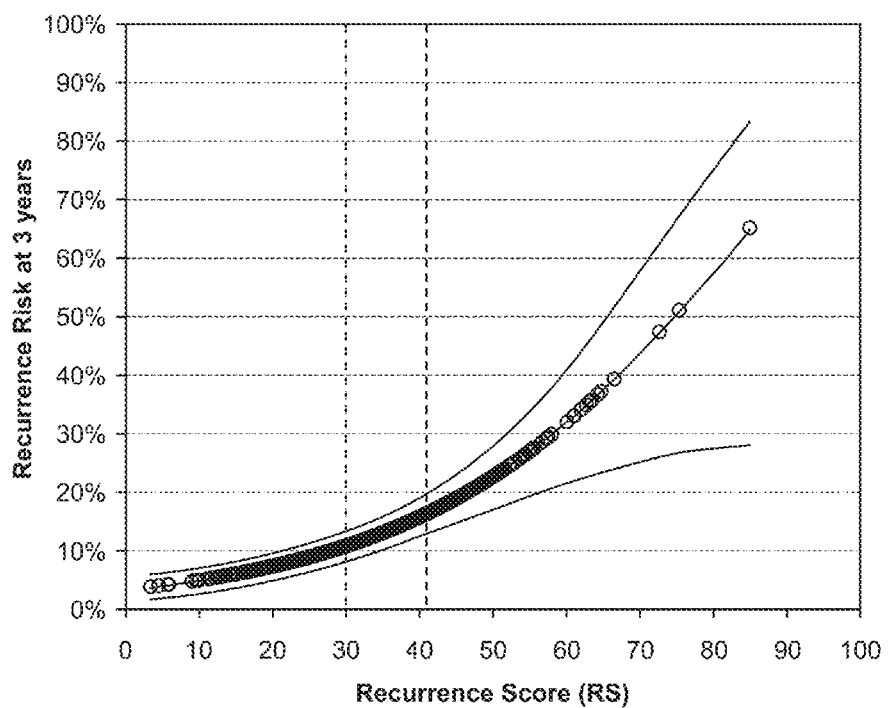
FIG. 4a provides a graph and a table illustrating a risk profile and recurrence scores (RS) for recurrence in Stage II colon cancer patients.
Figure 4B:
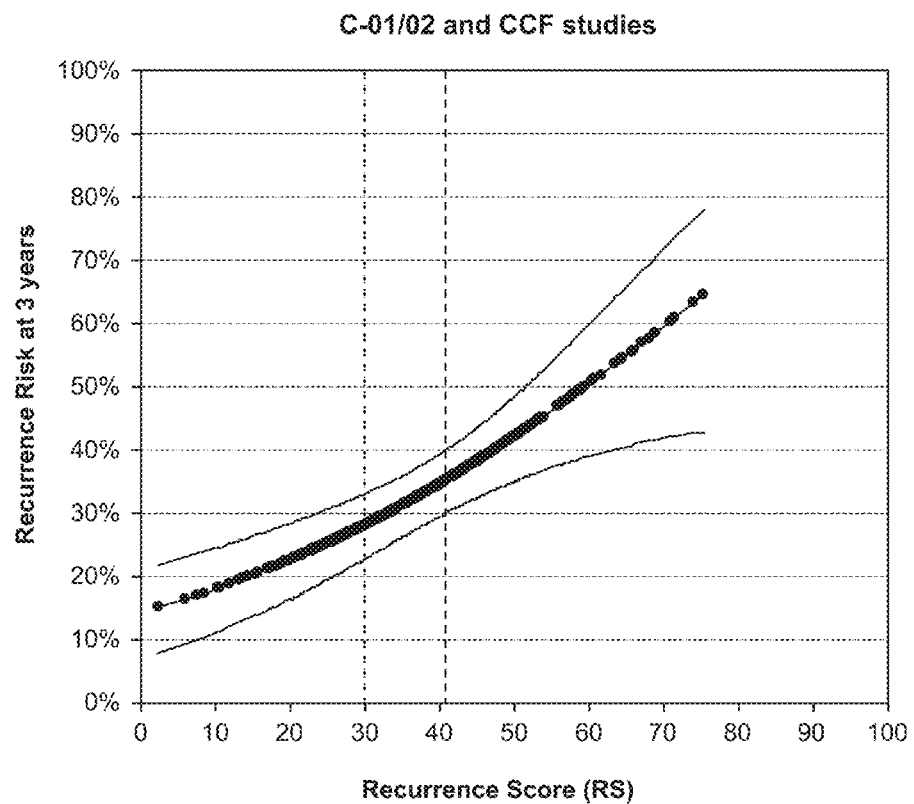
FIG. 4b provides a graph and a table illustrating a risk profile and recurrence scores (RS) for recurrence in Stage III colon cancer, surgery only patients.

Preliminary prognostic models were built using subsets of the 48 prognostic genes. The results from a representative model containing 10 prognostic genes are shown in FIGS. 3a and 3b for stage II and stage III patients, respectively, treated with surgery only (C-01/C-02 and CCF cohorts). Patients were divided into three equally sized groups based on the calculated Recurrence Score. This model separated the 628 Stage II patients into groups with low, intermediate and high risk of recurrence: the lowest tertile had a 5% (95% CI 3%, 9%) risk of recurrence at 3 years vs. 14% (10%, 20%) and 22% (16%, 28%), respectively, for the middle and highest tertiles. (See, FIG. 4a.) For 395 Stage III patients, the two lowest tertiles had 26% (19%, 35%) and 26% (19%, 34%) risk of recurrence at 3 years vs. a 47% (39%, 56%) risk for the highest tertile. (See FIG. 4b.) For comparison, the overall 3-year risks of recurrence of Stage II and Stage III patients were 13% and 33%, respectively. When bootstrap was applied, the average Kaplan-Meier estimates (and associated 95% confidence intervals) of recurrence rates at 3 years for stage II patients were 5% (2%, 9%), 12% (8%, 17%) and 22% (18%, 27%) for the $1^{st}$, $2^{nd}$ and $3^{rd}$ tertile, respectively. For stage III patients, the corresponding estimates were 23% (16%, 30%), 28% (19%, 37%) and 48% (40%, 56%), respectively.

EXAMPLE 3

Validation of Algorithm-Based Molecular Diagnostic Assay

After the 65 prognostic and 66 predictive gene candidates were identified, the genes were examined further for consistency in association between gene expression and RFI (prognosis) and differential relationship between with RFI in treated vs. untreated patients (prediction) across the four colon development studies using univariate and multivariate Cox proportional hazards models. Representation of the relevant biologic pathways, distribution of gene expression, functional form of the relationship between gene expression, and RFI and analytical performance of individual genes were also taken into account.

Forest plots for the predictive genes (after thresholding) were reviewed and genes were identified that (1) displayed predictive effects either in both Stage II and Stage III colorectal cancer, or in Stage III only; (2) had significant (e.g., p<0.10) gene by treatment interaction in a model of gene (n=9) or median $C_t$<4 (n=2); and (3) had significant (p<0.10) gene by treatment interaction after $RS_u$ and TRT were forced into the model. Genes with consistent univariate hazard ratios (HRs) were preferred. In addition, forest plots for the predictive genes were examined qualitatively and genes displaying predictive effects either in both Stage II and Stage III colorectal cancer, or in Stage III only were identified. Through this analysis the following additional 10 predictive gene candidates were identified (in addition to the 6 predictive genes in the final algorithm): RANBP2, BUB1, TOP2A, C20_ORF1, CENPF, STK15, AURKB, HIF1A, UBE2C, and MSH2. Based on these results, multi-gene models were designed and analyzed across all four studies. Those analyses, together with a methodical evaluation of analytical performance of each candidate gene, led to the design of a multi-gene RT-PCR-based clinical assay to predict recurrence risk and treatment benefit from $5FU/L_V$. The genes represent biological categories that are important in colon cancer: stromal group (BGN, FAP, INHBA, EFNB2), cell cycle group (Ki-67, MYBL2, cMYC, MAD2L1, HSPE1), cell signaling (GADD45B), apoptosis group (BIK), transcription factor group (RUNX1), and MSI group (AXIN2), as well as 5 reference genes (ATP5E, GPX1, PGK1, UBB, VDAC2) for normalization of gene expression.

Methods and Materials

Patients and Samples

The developed algorithm may be validated using samples obtained from the QUASAR study. The QUASAR Collaborative Group trial is the largest reported single randomized study of observation versus adjuvant chemotherapy in patients with resected stage II colon cancer. (See, Lancet 370:2020-2029 (2007).) In that study, patients with resected stage II and III colon and rectal cancer were assigned by treating physicians to one of two arms of the study based on either a "clear" or "uncertain" indication for adjuvant therapy. In the "clear" arm, all patients (n=4320) received adjuvant 5-FU/leucovorin (LV) chemotherapy with or without levamisole. In the "uncertain" arm, patients (n=3239) were randomized to either observation (n=1617) or adjuvant 5-FU/LV chemotherapy (n=1622). As expected, the "clear" arm enrolled primarily stage III patients (70%), and the "uncertain" arm enrolled a high proportion of stage II patients (91% stage II, 71% colon cancer).

Figure 5:
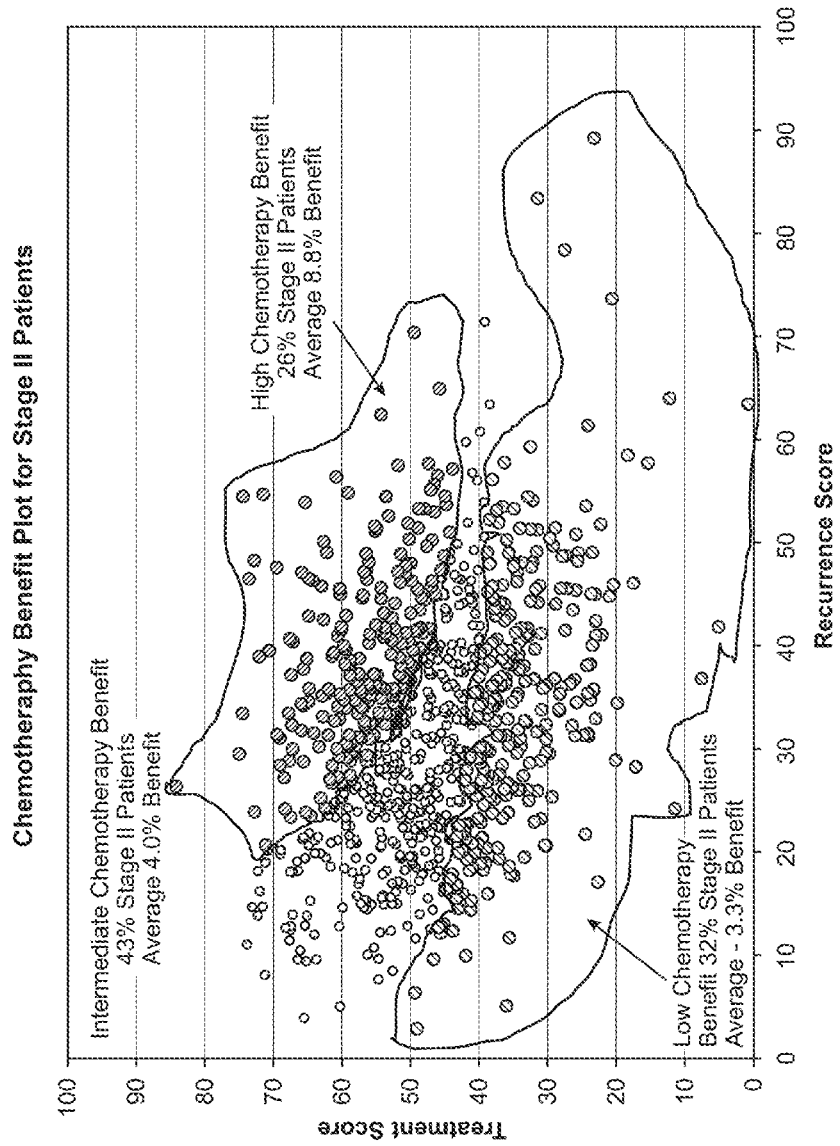
FIG. 5 is a graph providing a chemotherapy benefit plot for Stage II patients.
Figure 6:
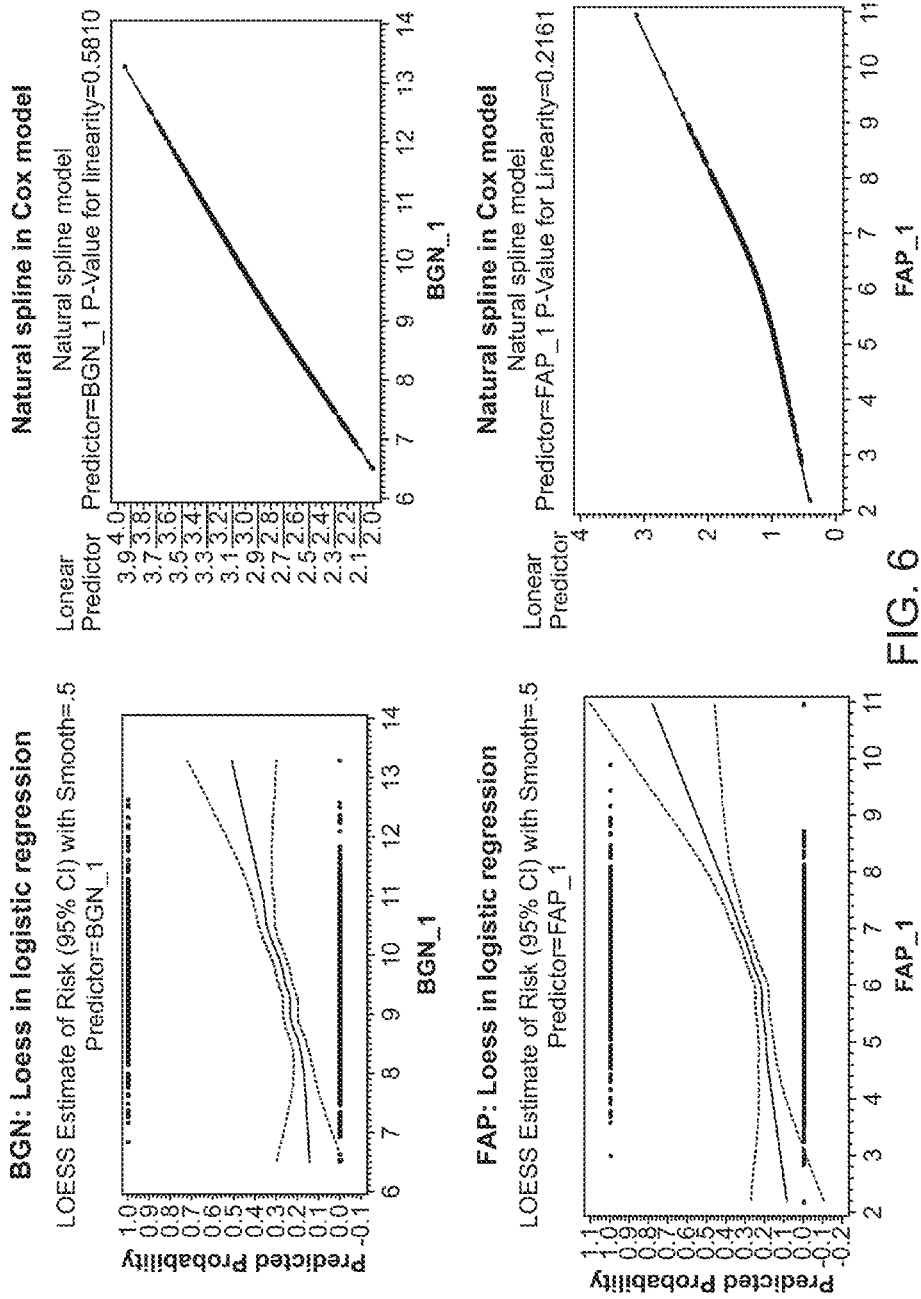
FIG. 6 provides a collection of graphs illustrating thresholding analysis for BGN, FAP and INHBA.
Figure 6:
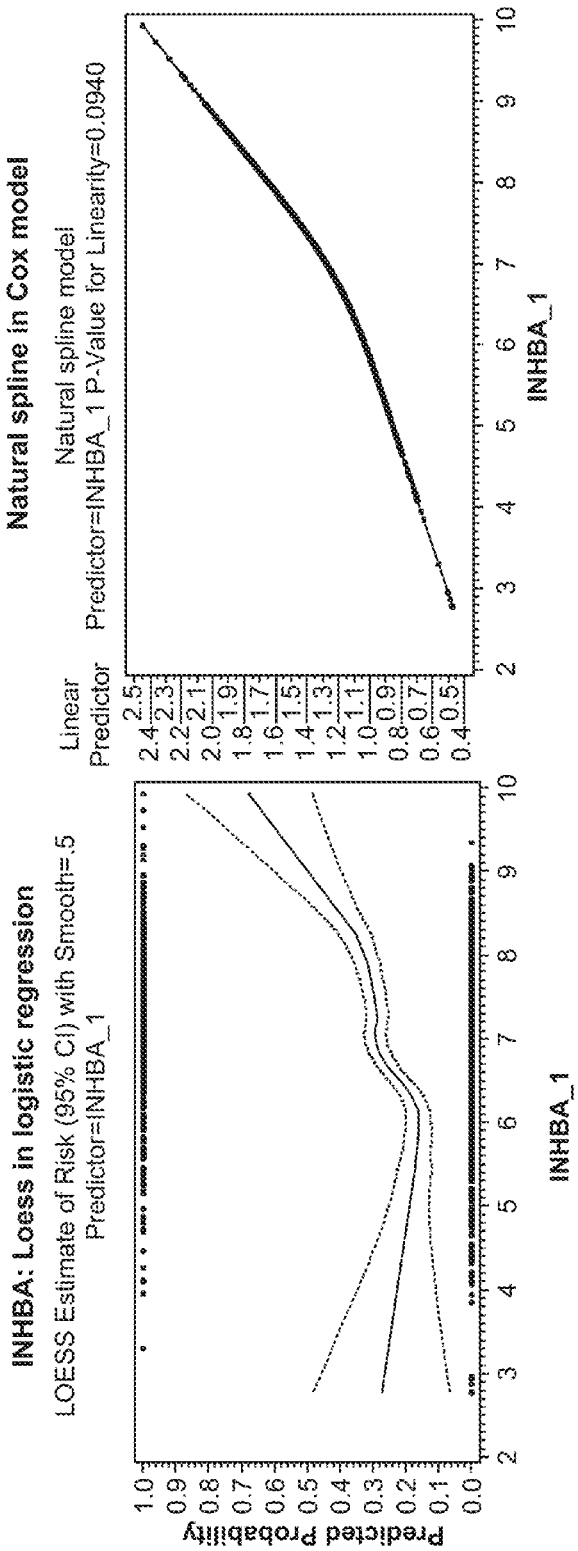
Figure 7:
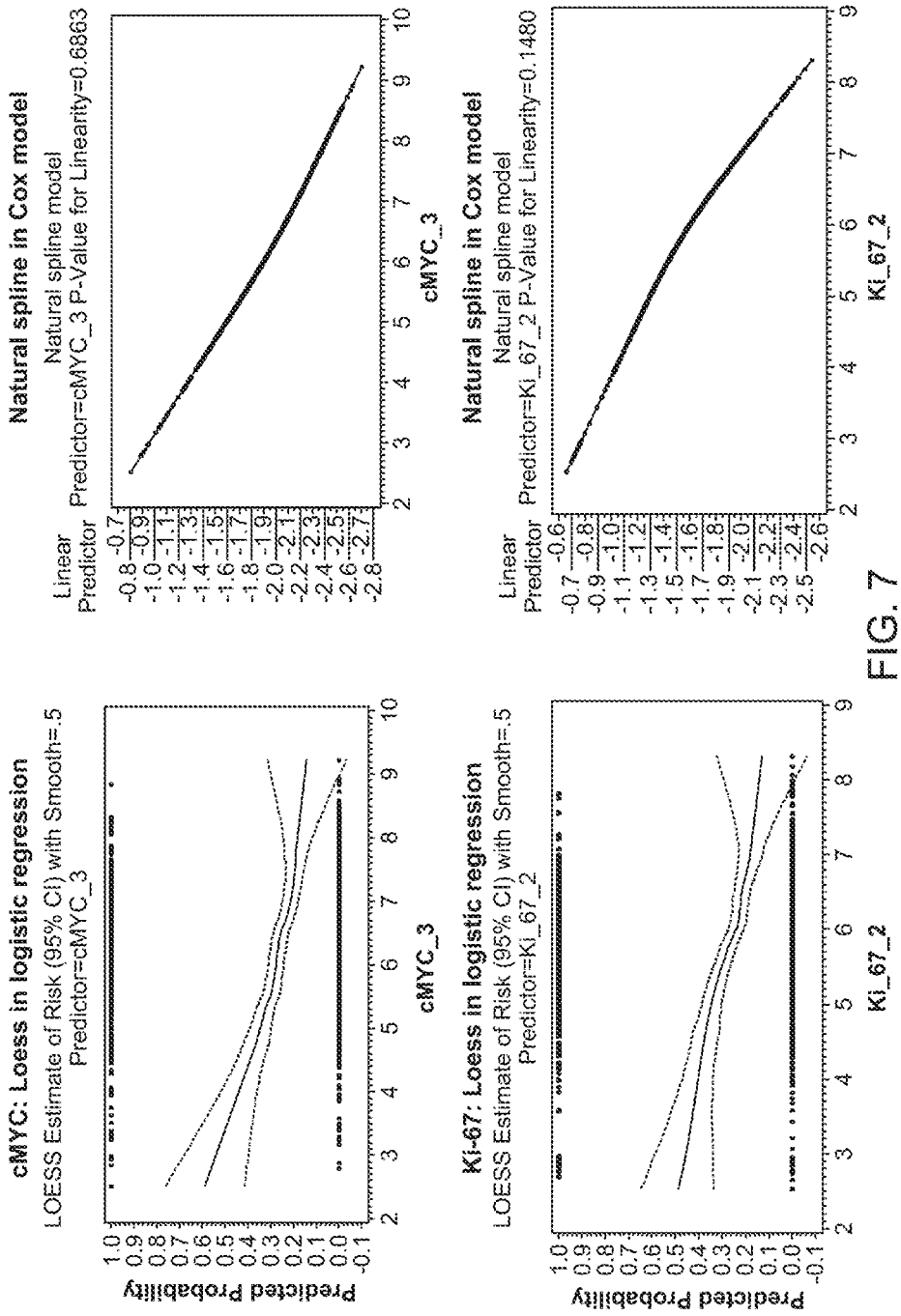
FIG. 7 provides a collection of graphs illustrating thresholding analysis for cMYC, Ki-67 and MYBL2.
Figure 7:
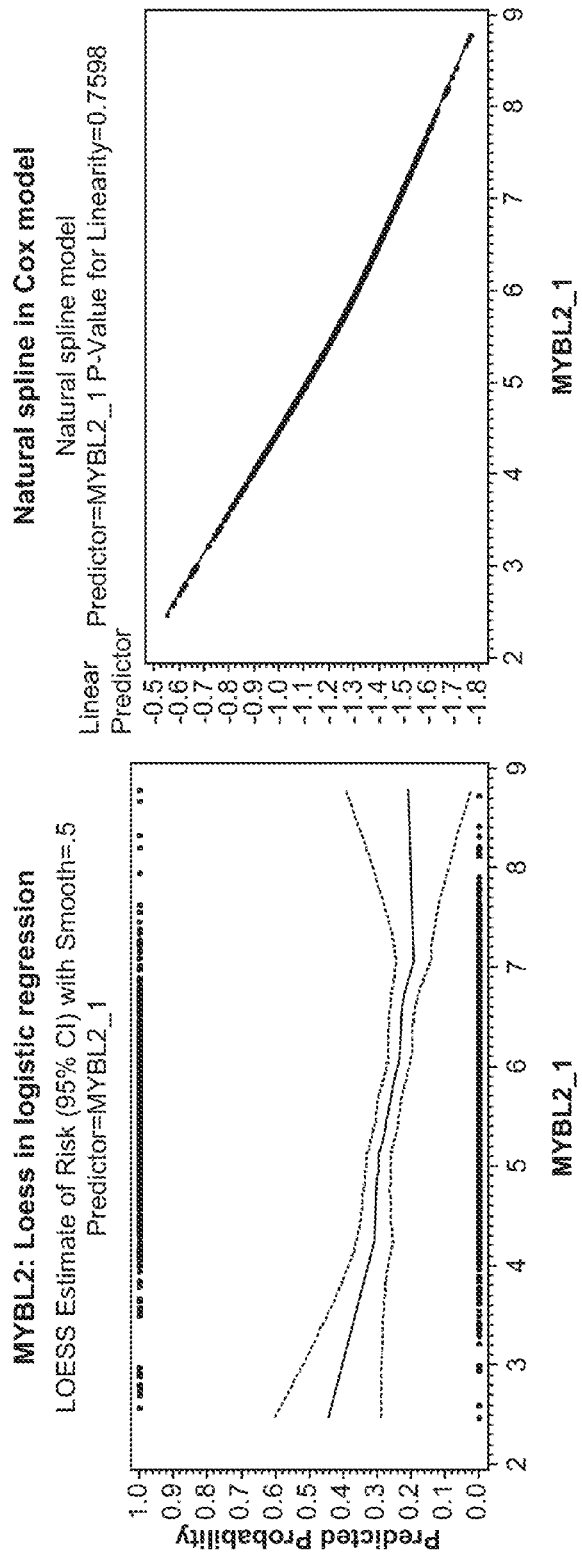
Figure 8:
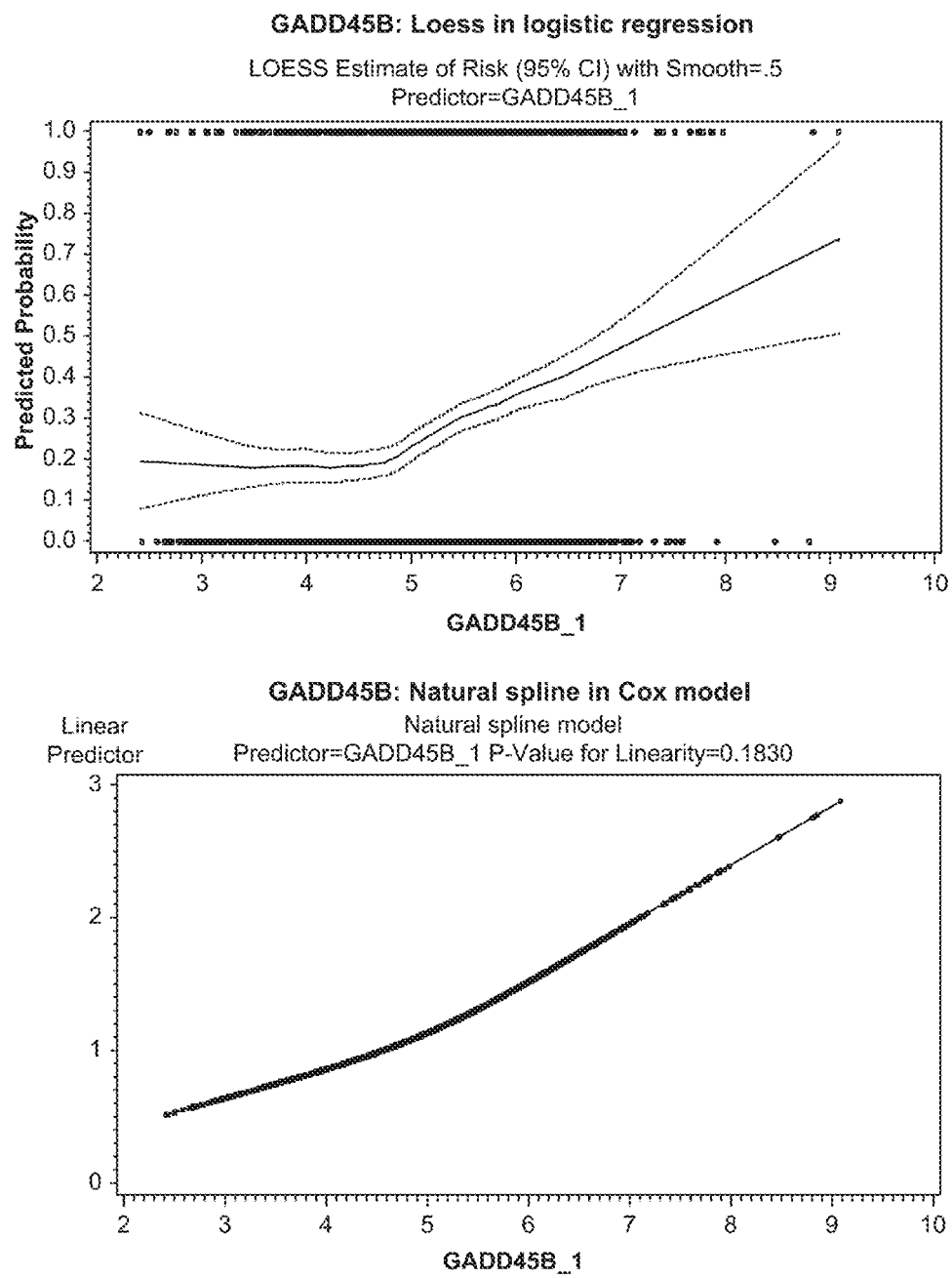
FIG. 8 provides a collection of graphs illustrating thresholding analysis for GADD45B.
Figure 9:
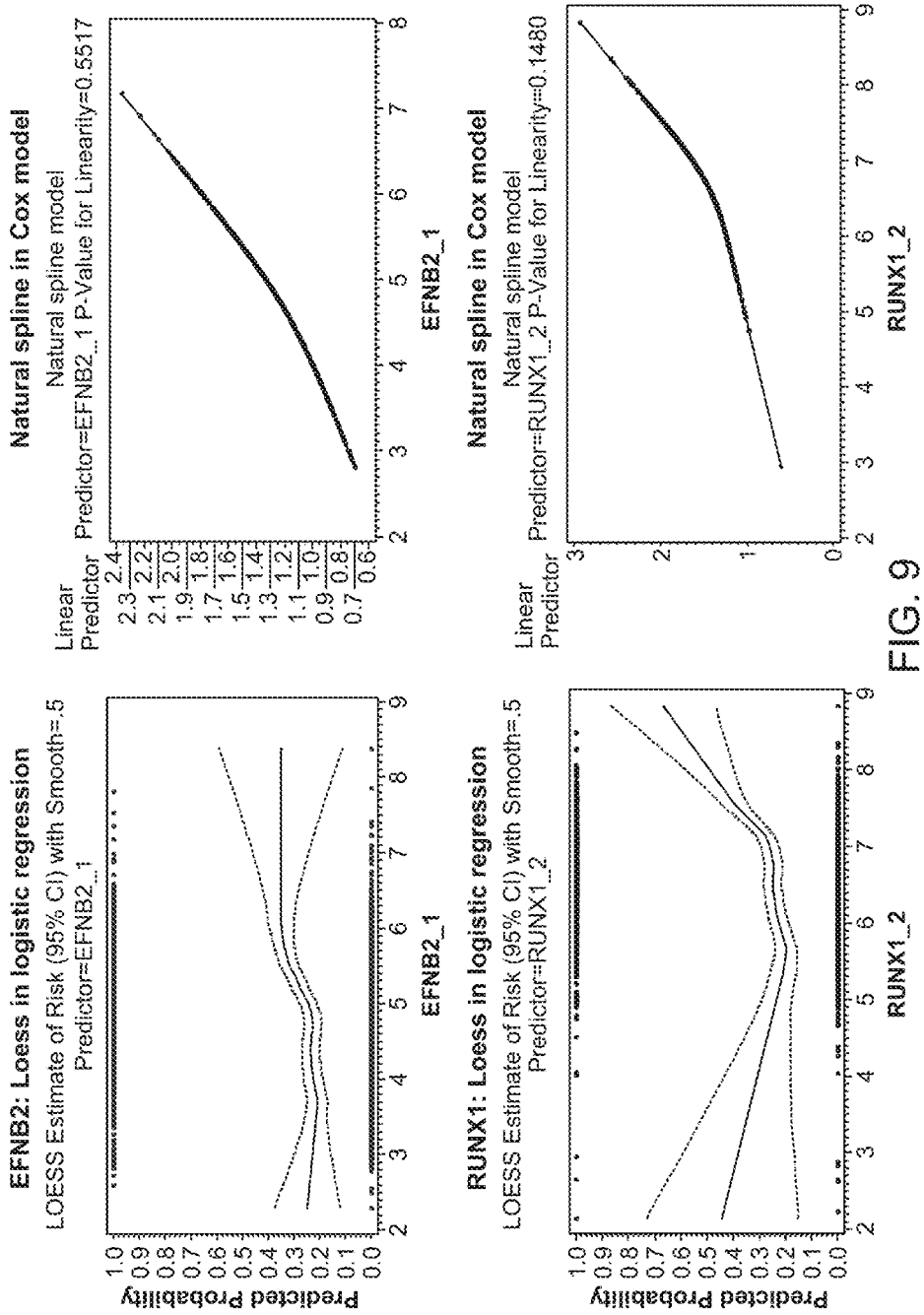
FIG. 9 provides a collection of graphs illustrating thresholding analysis for EFNB2, RUNX1 and BIK.
Figure 9:
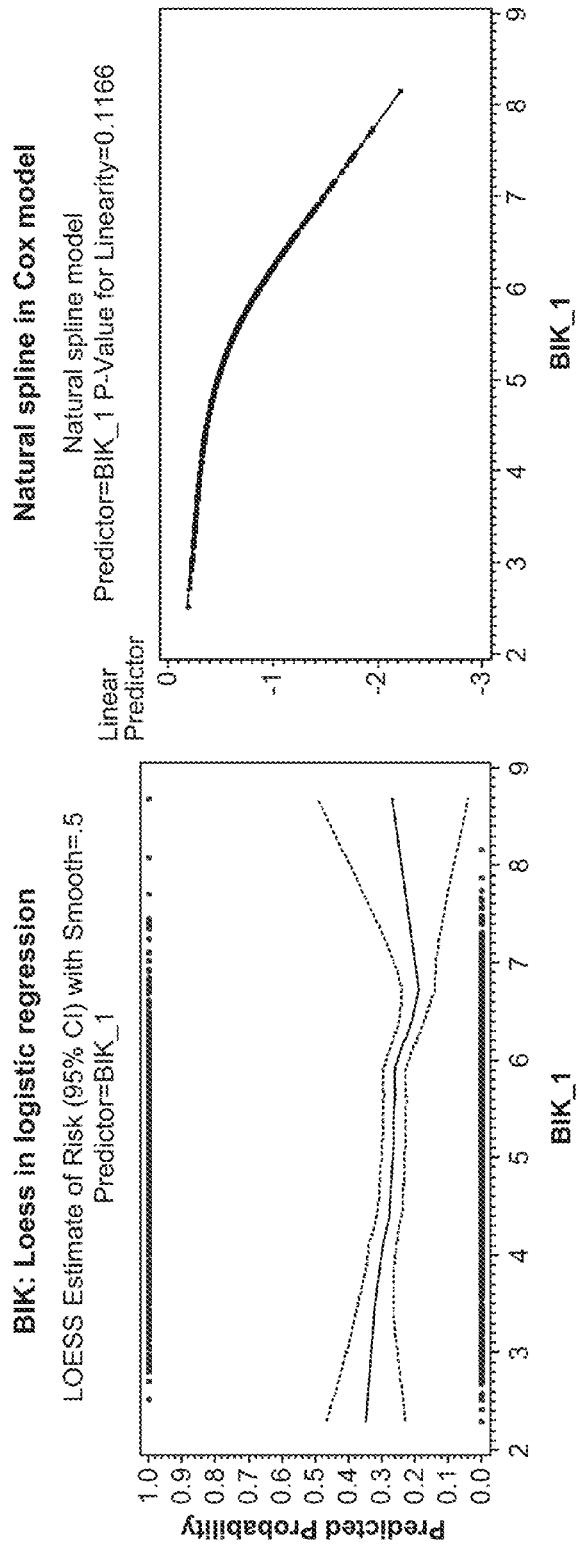
Figure 10:
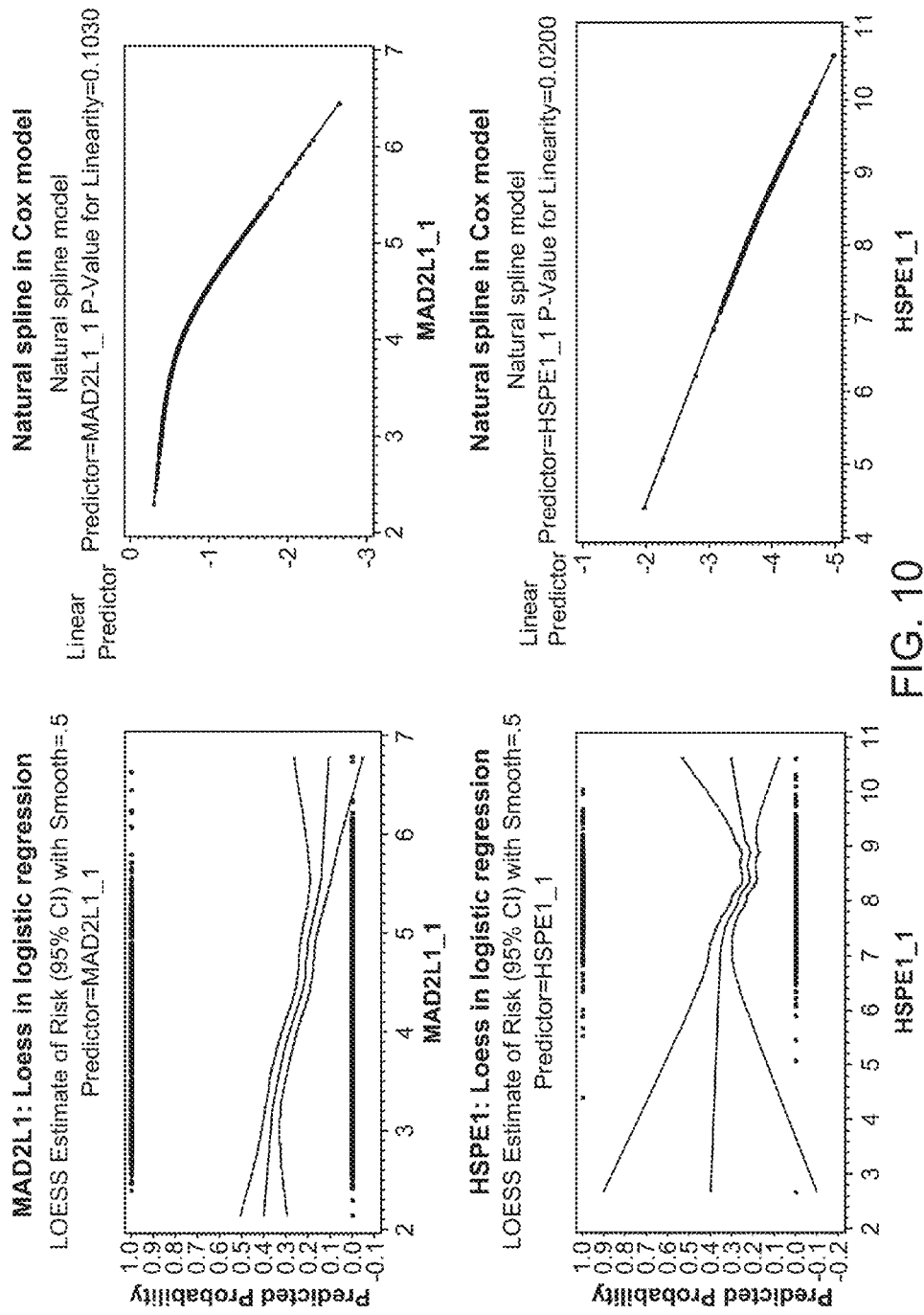
FIG. 10 provides a collection of graphs illustrating thresholding analysis for MAD2L1, HSPE1 and AXIN2.
Figure 10:
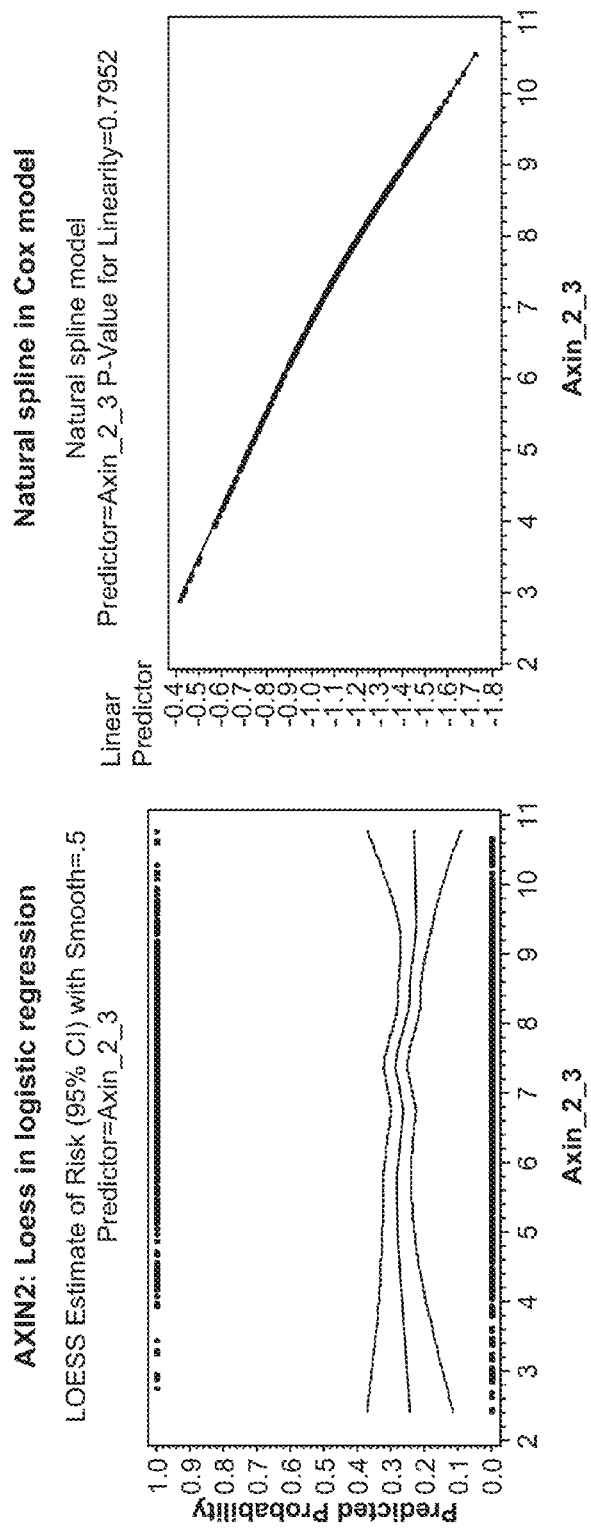

These results from QUASAR demonstrate that adjuvant 5-FU/LV treatment benefits a small but significant subset of stage II colon cancer patients. (See, e.g., FIG. 5.) Nevertheless, the physician managing stage II colon cancer still faces considerable challenges, including the fact that the majority of such patients are cured with surgery alone and that adjuvant 5-FU/LV chemotherapy carries potential toxicities of leucopenia, stomatitis, and diarrhea. Clearly, the decision to administer adjuvant 5-FU/LV chemotherapy would be greatly aided by the ability to identify reliably: 1) patients who are likely to be cured with surgery alone and 2) patients who are at substantial risk of recurrence following surgery and have a significant likelihood of clinical benefit with adjuvant treatment. With regard to the latter, it is worth emphasizing that the clinically relevant information for patients and oncologists includes not only the magnitude of the baseline risk of recurrence but also the magnitude of potential benefit (i.e. the absolute clinical benefit) associated with adjuvant 5-FU/LV treatment.

The validation study entailed the use of a pre-specified RT-PCR-based 18-gene clinical assay (see genes listed in Table 3) applied to archival paraffin-embedded tumor tissue specimens from colon cancer patients studied in QUASAR. The study considered the relationship between (1) a continuous RS and recurrence risk in patients randomized to surgery alone, and compared to that of patients randomized to surgery followed by adjuvant 5-FU/LV chemotherapy (controlling for simultaneous prognostic effects of clinical and pathological covariates); and (2) a continuous TS and chemotherapy benefit in patients randomized to surgery alone or surgery followed by adjuvant 5-FU/LV chemotherapy. The study compared the risk of recurrence between the high and low recurrence risk groups based on pre-specified cut-points for RS. A two-fold higher recurrence risk at 3 years in the high recurrence risk group compared to the low recurrence risk group was considered clinically significant. Alternative clinical endpoints, including RFI, DFS and OS, were considered. The study also looked for a significant (1) trend in absolute chemotherapy benefit for recurrence at 3 years across the low, intermediate, and high chemotherapy benefit groups; (2) interaction between the continuous TS and treatment relative to alternative clinical endpoints, including RFI, OS and DFS; (3) interaction between MMR status and treatment after controlling for the prognostic effects of the continuous RS and prognostic covariates.

Fixed paraffin-embedded colon tumor tissue from approximately 1,500 patients from QUASAR with stage II colon cancer. The RNA was extracted from the tumor tissue and RT-PCR analysis was conducted to determine expression levels of 13 cancer-related and 5 reference genes (Table 3). A prospectively-defined algorithm was used to calculate a RS and TS for each patient. Patients were classified into low, intermediate, and high recurrence risk groups using the RS and pre-specified cut-points (Table 1). Similarly, patients were classified into low, intermediate, and high chemotherapy benefit groups based on the combination of the RS and TS and on pre-specified cut-points (Table 2). These cut-points define the boundaries between low and intermediate benefit groups and between intermediate and high benefit groups.

The specimens were also assessed by pathology to determine: tumor type, tumor grade, presence of lymphatic and/or vascular invasion, number of nodes examined, depth of invasion (pathologic T stage), MMR status, and other QC metrics. This information was used to determine whether there was a significant relationship between risk of recurrence and individual and pathologic covariates.

Expression levels of 13 cancer-related genes used in the calculation of the RS and TS were reported as values from the RT-PCR assay. Gene expression measurements were normalized relative to the mean of five reference genes (ATP5E, GPX1, PGK1, UBB, VDAC2). For each cancer-related gene, a cycle threshold ($C_T$) measurement was obtained by RT-PCR, and then normalized relative to a set of five reference genes. Reference-normalized expression measurements typically range from 0 to 15, where a one unit increase generally reflects a 2-fold increase in RNA quantity.

Analysis Methods:

Unless otherwise stated, all significance tests were conducted at the 0.05 significance level, and two-sided p-values and confidence intervals will be reported. To preserve the overall family-wise error rate for testing the primary objectives at the 0.05 significance level, the analysis applied conditional fixed sequential testing. A Cox proportional hazards regression model was fit to the clinical endpoint RFI for the patients who were randomized to surgery alone and a likelihood ratio test used to determine if the RS is significantly associated with the risk of recurrence (i.e. if the hazard ratio associated with the RS is significantly different from 1).

A Cox proportional hazards regression was used to model the first 3 years of follow-up data, that is, censoring time to recurrence at 3 years after randomization for patients who have not experienced a recurrence before that time, to determine if the TS is associated with the magnitude of chemotherapy benefit. The likelihood ratio test was used to compare the reduced model with RS, TS and the treatment main effect, with the full model that includes RS, TS, the treatment main effect, and the interaction of treatment and TS. In addition, we will use the method of Royston and Parmar (2002) to fit a flexible parametric model to RFI using all available follow-up data. The method will model the hazard of recurrence using the Weibull distribution with natural spline smoothing of the log cumulative hazards function, with effects for treatment (chemotherapy or observation), RS, TS and the interaction of TS with treatment, allowing the effects of treatment, RS, TS and TS interaction with treatment to be time dependent. The predicted effect of chemotherapy as a function of TS will be estimated at follow-up times of 2, 3, and 5 years.

Power calculations were carried for the Cox proportional hazards model with a single non-binary covariate using the method proposed by Hsieh and Lavori (2000) as implemented in PASS 2008. One skilled in the art would recognize that power at alpha 0.01-0.05 alpha would be sufficient to control for type I error.

For example, a test comparing a reduced Cox proportional hazards regression model of gene expression and treatment to a full model containing gene expression, treatment and interaction of gene expression and treatment indicated an association of chemotherapy benefit and expression of RUNX1 (p=0.030, Interaction HR=0.59, HR 95% CI (0.37, 0.95) and FAP (p=0.065, Interaction HR=0.66, HR 95% CI (0.42, 1.03).

The association of gene expression and recurrence risk in surgery alone patients was examined for the 13 cancer-related genes. Multivariate Cox proportional hazards regression model allows estimation of recurrence risk adjusted for a specific distribution of clinical covariates. Recurrence risk estimates were produced from this multivariate model, adjusting for distribution of clinical covariates, differences in distribution in various study populations (if any), and baseline survival.

Figure 12:
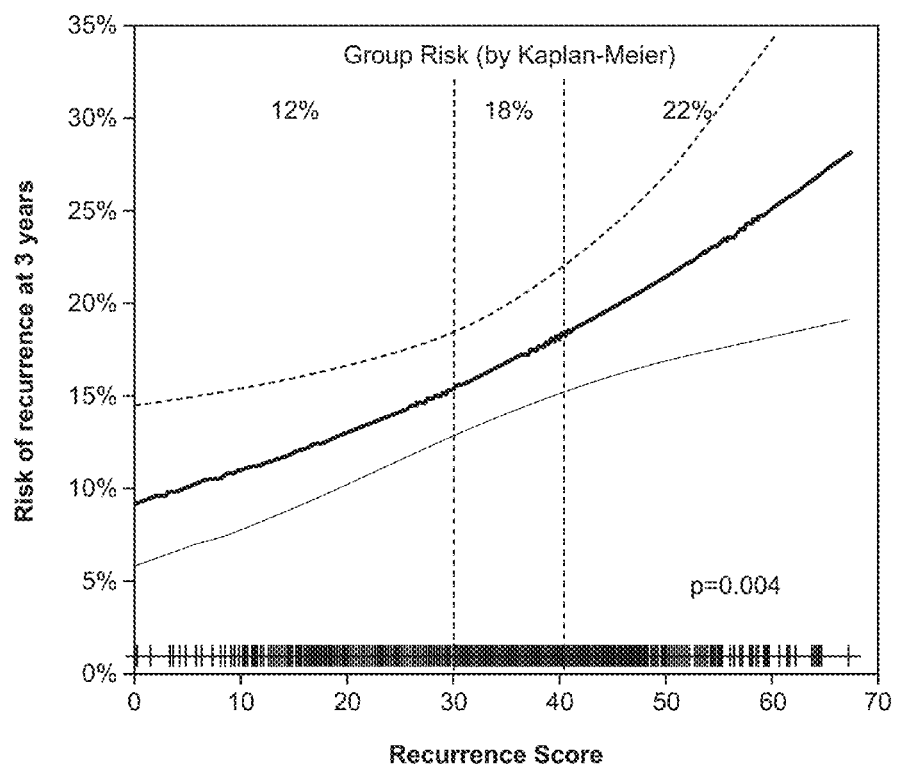
FIG. 12 is a Kaplan Meier curve demonstrating group risk from the QUASAR Stage II colon cancer patients treated with surgery alone.
Figure 13:
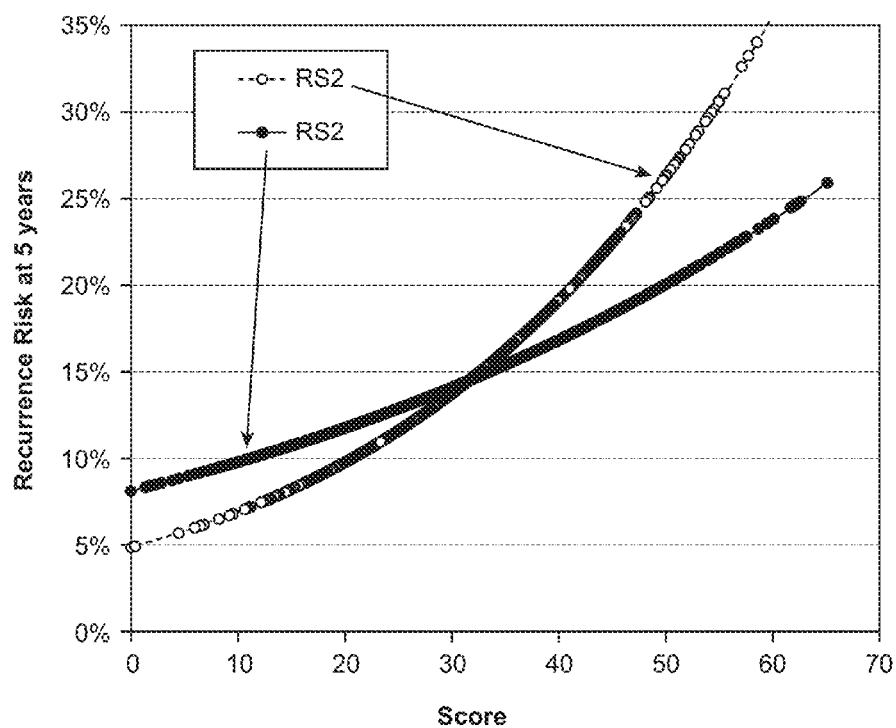
FIG. 13 is a risk profile plot (by Kaplan Meier curve) for risk of recurrence at five years and recurrence scores.

Table 8 presents the results of the univariate Cox proportional hazards regression models of gene expression on RFI. FIG. 12 demonstrates the group risk (by Kaplan Meier curve) for Stage II colon cancer patients following surgery based on risk of recurrence at three years and recurrence score (including stromal and cell cycle group genes). FIG. 13 demonstrates the risk profile plot (by Kaplan Meier curve) for risk of recurrence at five years (QUASAR—surgery only) and recurrence score (including stromal, cell cycle, and (for RS2) apoptosis genes).

In addition, the analyses combining the results from the four colon development studies and the QUASAR validation study were carried out to assess the performance of the 13 cancer-related genes across more than 3000 patients. Two different analysis methods were applied to combine the results across studies: (1) meta-analysis treating inter-study variation as random using the method of Paule and Mandel (1982) as implemented by DerSimonian and Kacker (2007); and (2) Cox proportional hazards regression model stratified by study, stage and treatment. Table 9 presents the results of these analyses. As can be observed, all but AXIN were shown to be associated with risk of recurrence in colon cancer (i.e. 95% CI did not include 1). (See, e.g., R. Paule, J. Mandel, Journal of Research of the National Bureau of Standards 87:377-385 (1982); R. der Simonian and R. Kacker, Cotemp. Clin Trials 28:105-144 (2007), both incorporated herein by reference.)

EXAMPLE 4

Alternative Algorithm-Based Assay

Figure 17:
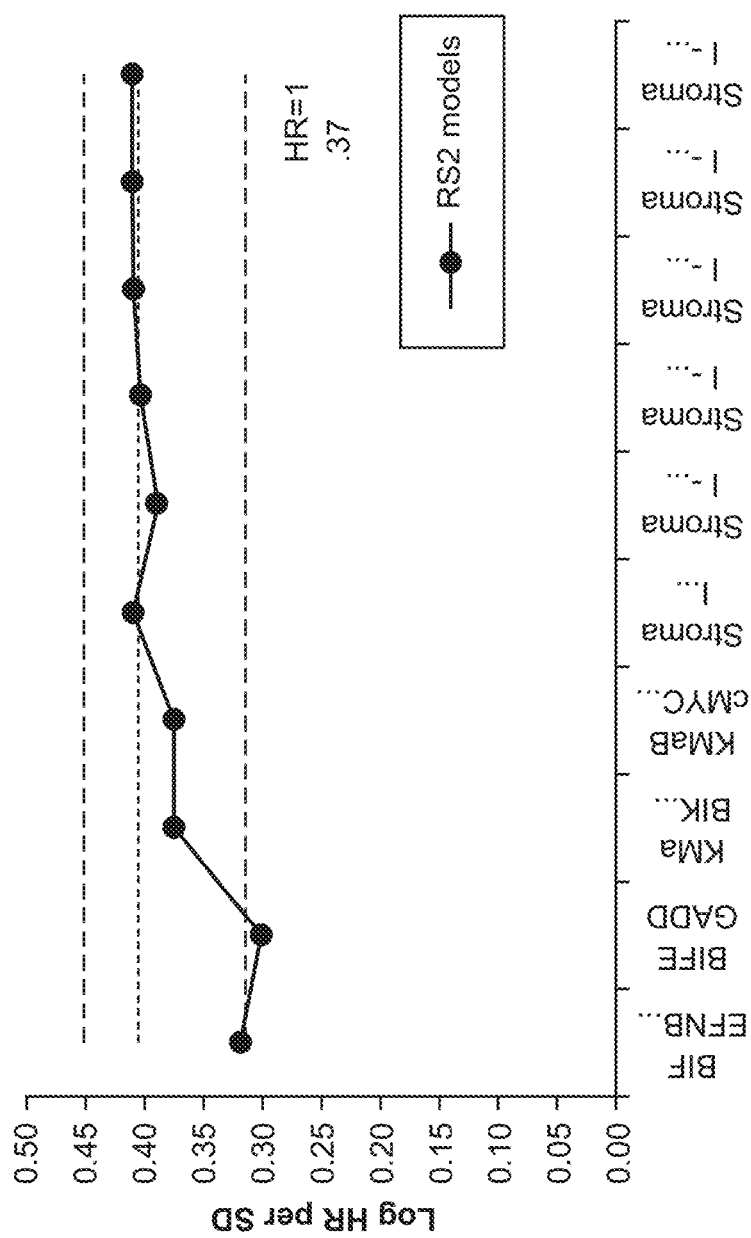
FIG. 17 is a graph showing the range of performance for multi-gene recurrence score models across all colon cancer studies
Figure 18:
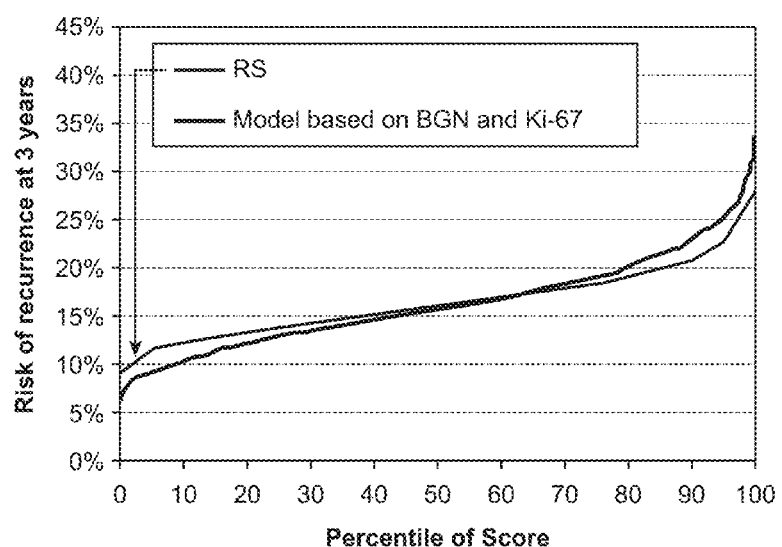
FIG. 18: Performance of two gene model including a Stromal group gene (BGN) and Cell cycle group gene (Ki-67)
Figure 19:
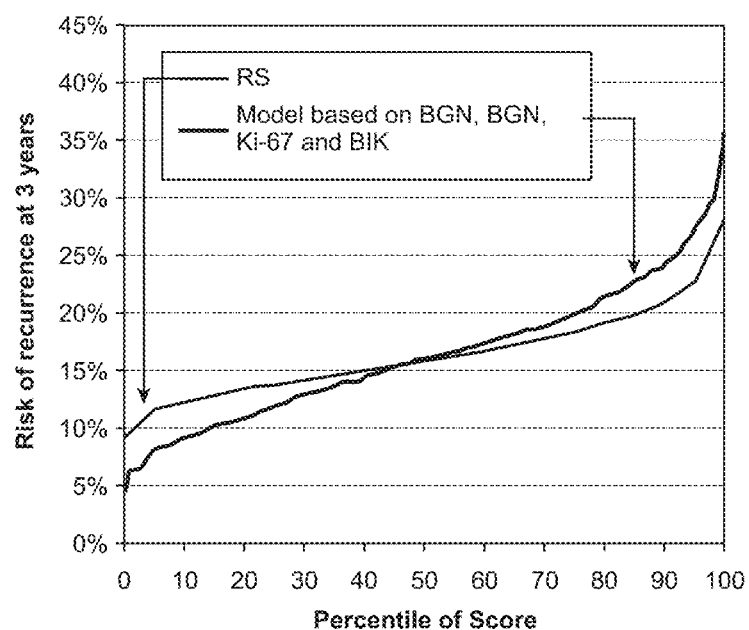
FIG. 19: Performance of three gene model including a Stromal group gene (BGN), a Cell cycle group gene (Ki-67) and an Apoptosis group gene (BIK)

Further analysis of data from the studies outlined in the Examples above suggested that incorporating additional genes into the Recurrence Score gene panel may yield improved performance. For example, BIK and EFNB2 were significantly associated with recurrence risk in both surgery alone and 5FU-treated patients. Statistical modeling was conducted to explore the strength of association between several multi-gene modules and recurrence of colon cancer. Table 10 and FIGS. 17-19 demonstrate comparative prognostic performance of selected multi-gene models.

Table 10: Multi-gene models based on standardized gene expression.

TABLE 10

| | | | SCORE | | | | |
|---|---|---|---|---|---|---|---|
| | | | STD | LR | | Genes | |
| N | Variable | N | HR | Chisq | Est | StdHR | LRChisq | LRPVal |
| 1 | BGN | 3137 | 1.57 | 140.2 | 0.09 | 1.09 | 1.13 | 0.29 |
| | FAP | | | | −0.09 | 0.91 | 1.93 | 0.16 |
| | INHBA | | | | 0.10 | 1.11 | 2.29 | 0.13 |
| | EFNB2 | | | | 0.19 | 1.22 | 26.02 | 3.4E−07 |
| | GADD45B | | | | 0.02 | 1.02 | 0.16 | 0.69 |
| | Ki-67 | | | | −0.13 | 0.88 | 6.37 | 0.01 |
| | MAD2L1 | | | | −0.13 | 0.88 | 6.35 | 0.01 |
| | BIK | | | | −0.15 | 0.86 | 12.91 | 3.3E−04 |
| | cMYC | | | | −0.13 | 0.88 | 9.10 | 0.003 |
| | MYBL2 | | | | −0.02 | 0.98 | 0.25 | 6.2E−01 |
| 2 | BGN + INHBA + FAP + EFNB2 | 3137 | 1.52 | 120.7 | 0.07 | 1.23 | 19.85 | 8.4E−06 |
| | GADD45B | | | | −0.02 | 0.98 | 0.13 | 0.72 |
| | Ki-67 + MAD2L1 + BIK | | | | −0.13 | 0.77 | 39.19 | 3.8E−10 |
| | cMYC | | | | −0.10 | 0.91 | 5.50 | 0.02 |
| | MYBL21 | | | | −0.01 | 0.99 | 0.10 | 0.75 |
| 3 | BGN + INHBA + FAP + EFNB2 + ⅓ GADD45B | 3137 | 1.51 | 118.9 | 0.06 | 1.22 | 25.61 | 4.2E−07 |
| | Ki-67 + MAD2L1 + BIK + ¾cMYC + ½ MYBL2 | | | | −0.12 | 0.74 | 54.97 | 1.2E−13 |
| 4 | BGN + INHBA + FAP + EFNB2 + ⅓ GADD45B | 3137 | 1.51 | 119.6 | 0.06 | 1.21 | 24.60 | 7.1E−07 |
| | Ki-67 + MAD2L1 + BIK + ½cMYC + ½ MYBL2 | | | | −0.13 | 0.74 | 55.61 | 8.8E−14 |

Figure 20:
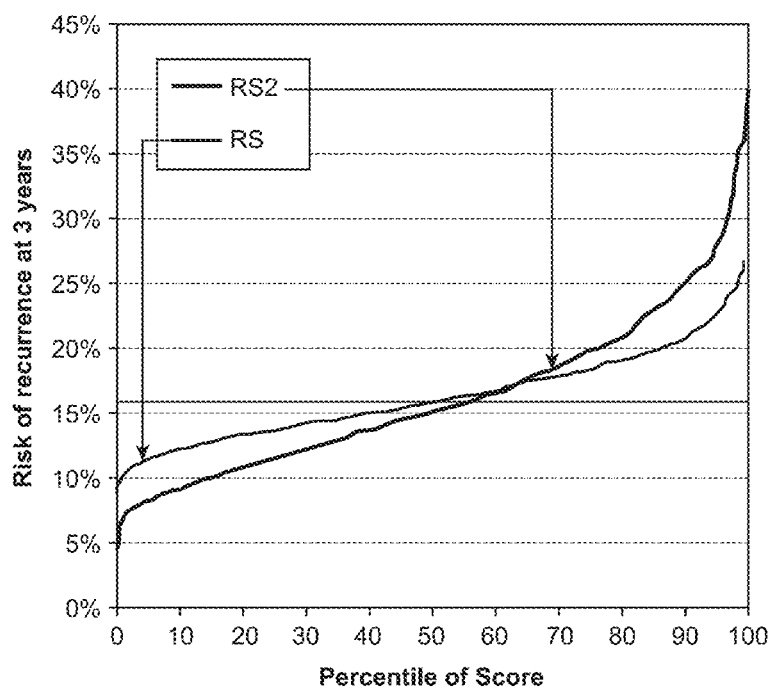
FIG. 20: Comparative performance of ten-gene prognostic model (RS2) vs. seven-gene prognostic model (RS) in surgery-alone patients from the QUASAR study

Based on the statistical modeling, it was determined that a multi-gene model using BGN and Ki-67, or BGN, Ki-67 and BIK, can provide minimal prognostic information to colon cancer patients. See FIG. 18-19. However, a model consisting of ten prognostic genes (BGN, FAP, INHBA, EFNB2, GADD45B, Ki-67, MAD2L1, BIK, cMYC, MYBL2), plus reference genes ("RS2"), provided a highly accurate assessment of risk of recurrence in colon cancer. See FIG. 20.

EXAMPLE 5

Identifying Co-Expressed Genes and Gene Cliques

Gene cliques that co-express with the validated prognostic and predictive genes are set forth in Tables 4-6. These gene cliques were identified using the method described herein.

Materials and Methods:

Microarray data for colon tumor samples may be obtained internally, or derived from a public database, such as Gene Expression Omnibus (GEO). Microarray data was normalized and a pairwise Spearman correlation matrix computed for all array probes. Significant co-expressed probes across different studies was filtered out, and a graph built to compute probe cliques, map the probes to genes, and generate the gene cliques.

Download Colon Cancer Microarray Datasets

Five datasets from the Gene Expression Omnibus (GEO) database were used to compute the colon cliques. These datasets were identified as colon tumor expression experiments using the Affymetrix® HG-U133A microarray chip (Affimetrix Inc., Santa Clara, Calif.). Detailed information regarding the GEO database can be found at the National Center for Biotechnology Information (NCBI) website. Table 7 provides the accession number for the Geo datasets and the number of tumor samples in each dataset.

Array Data Normalization

The array data from GEO may be normalized using appropriate software, e.g. Affymetrix MAS5.0, or an open source RMA software like the bioconductor package.

If the sample array data are of MAS5.0 type, they are normalized with the following steps:
1. Expression level is changed to "10" if the value is <10.
2. Expression level is then log transformed.
3. Median is computed on the log transformed values for the whole array probes.
4. Each probe value subtracts the median and the resulting value will be defined as normalized value If the sample array data are of RMA type, they are normalized with the following steps:
1. Median is computed on the RMA generated values for the whole array probes.
2. Each probe value subtracts the median and the resulting value will be defined as normalized value Array Probe Co-Expression Pair Generation The Spearman's rank correlation coefficient ($r_s$) was calculated for every unique pair of probes in the dataset (22283 probes resulting 248,254,903 unique pairs for each dataset). These pairs were then filtered by a significant threshold value T; any probe pair which has an $r_s >= T$ was considered significant. Significant correlation pairs (had Spearman correlation values above threshold) were generated for each GEO dataset. For a given seeding gene probe, if the significant pairs involving the seeding probe or its directly connected probes existed across all five GEO datasets, they were placed in a graph and used to calculate maximal cliques.

Array Probe Clique Generation

The Brön-Kerbosch algorithm was used to generate the maximal cliques from a graph of significant probe pairs generated from the above step. First, three "sets" of nodes were created. The first set, compsub, was the set to be extended or shrunk on traveling along a branch of the backtracking tree. The second set, candidates, was the set of all points that will be added to compsub. The third set, not, was the set of nodes already added to compsub. The recursive mechanism for generating cliques is as follows:
1. Selection of a candidate node.
2. Adding the selected candidate node to compsub.
3. Creating new sets candidates and not from the old sets by removing all nodes not connected to the selected candidate, keeping the old sets in tact.
4. Calling the extension operator to operate on the sets just formed.
5. Upon return, removal of the selected candidate from compsub and its addition to the old set not.

Figure 11:
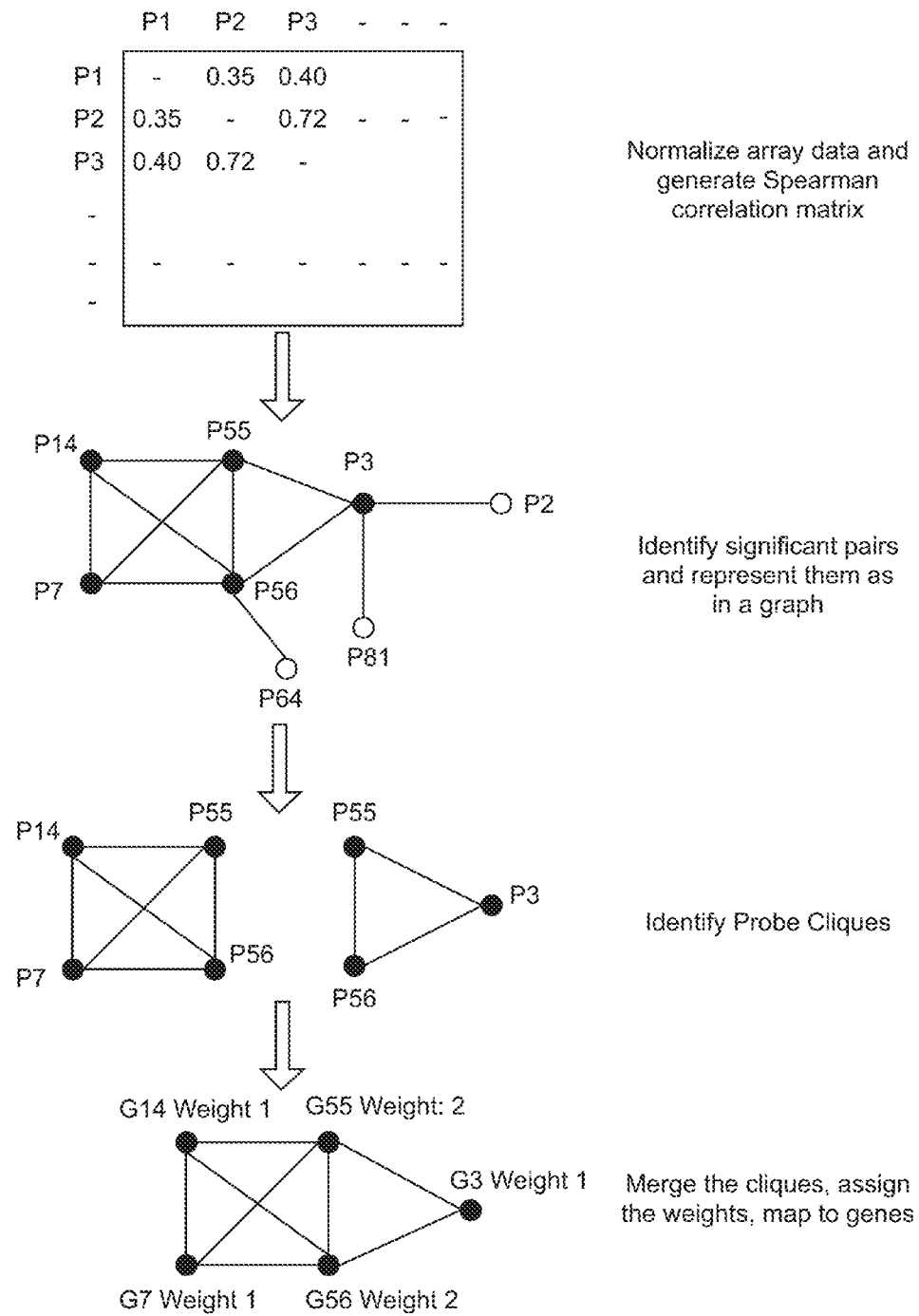
FIG. 11 is a schematic illustrating seeding of gene cliques.

If after the extension operator, the candidates and not sets were empty, then the nodes on compsub were a clique and the mechanism starts over with a new candidate node. (See FIG. 11.)

Gene Clique Reporting

After the probe cliques had been computed, each probe in the cliques was mapped to genes as identified by Entrez Gene Symbol (Official Gene Symbol). Table 6 lists the report for the cliques associated with FAP, INHBA, Ki-67, HSPE1, MAD2L1, and RUNX1.

Certain probes have multiple mapping to Genes. They are listed as the same AffyProbeID within a SeedingGene but have multiple ambiguous map to Official Genes (listed as CliquedGene column). Certain CliquedGenes are listed as "---" in Table 6. That means the AffyProbes do not map to any current Official Genes. The weight column list out the weight as we merged cliques. It is essentially is the number of clique evidence for coexpression with the seeding gene.

EXAMPLE 6

Use of Thresholding

Thresholding can be used to improve the reproducibility in recurrence score (RS) and treatment score (TS) reporting by accounting for significant losses in precision as gene expression measurements approach the limit of quantitation (LOQ) of the assay. The LOQ of an assay represents the lowest concentration of RNA at which results can reliably be reported and have been estimated for each of the 18 colon cancer genes.

Figure 26:
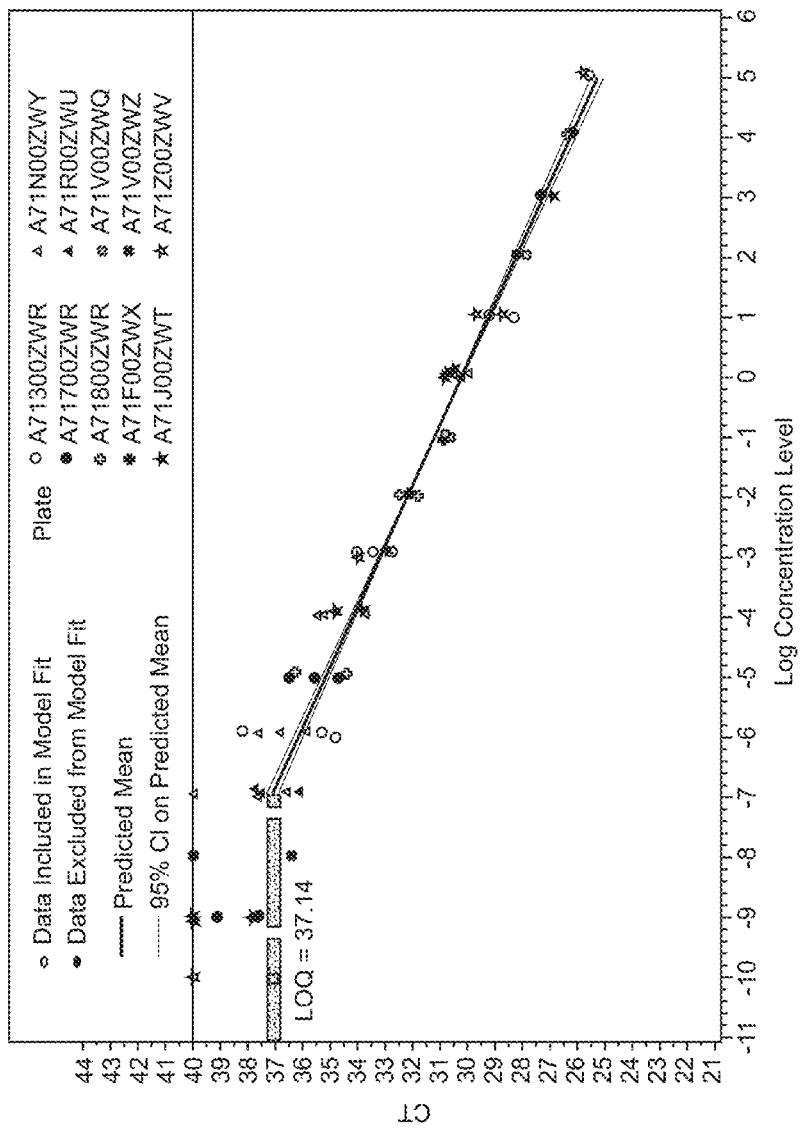
FIG. 26 is a graph showing the effects of diluting RNA concentration on (non-normalized) gene expression ($C_t$) measurements of Ki-67.

As an example, FIG. 26 shows the effects of diluting RNA concentration on (non-normalized) gene expression ($C_t$) measurements of Ki-67. The variance in $C_t$ measurement clearly increases as RNA concentration decreases. In fact, it may be shown that the log variance in $C_t$ measurement is roughly proportional to the mean $C_t$ measurement for a gene. As a consequence, the variability in RS and TS may be further reduced by truncating gene expression measurements at or near the LOQ, thereby reducing the potential for noise being introduced into RS and TS estimation.

EXAMPLE 7

Calculating Gene Expression: Tumor Region Ratios

The clinical development studies in stage II/III colon cancer described above illustrated that genes which are frequently associated with stroma are correlated with increased risk of recurrence, whereas cell cycle genes are correlated with decreased risk of recurrence. This fact may account for the variability of RS/TS scores, and could be taken into account if the algorithm described herein considered the amount of stroma and luminal area, as well as localized gene expression in these regions. For example, an algorithm taking into account the ratios of stromal gene expression values per stroma area unit, and cell cycle gene expression values per epithelial area unit, would increase the precision and reproducibility of a recurrence risk prediction by decreasing heterogeneity within tumor blocks for a given patient.

Figure 14:
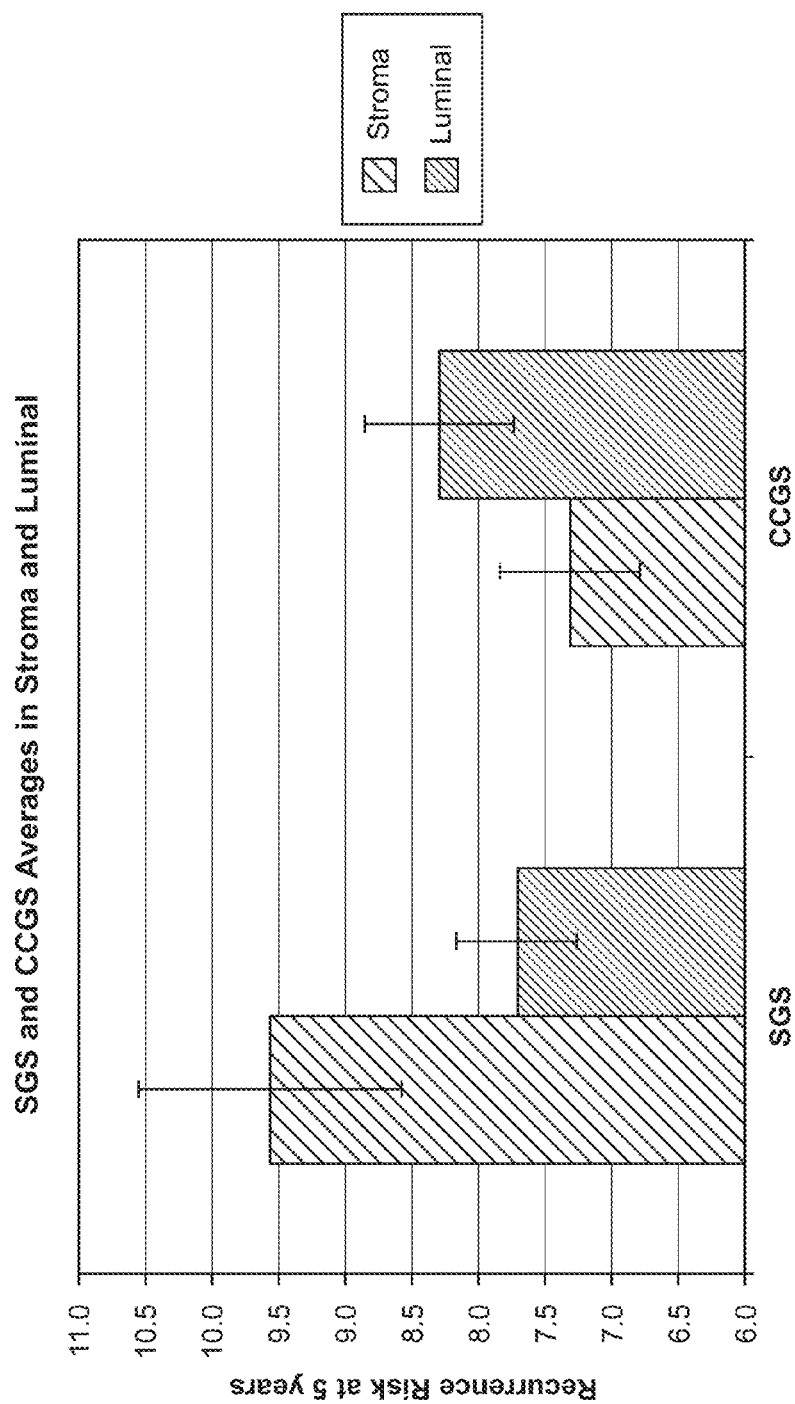
FIG. 14 is a graph showing stromal group score (SGS) and cell cycle group score (CCGS) in tumor-associated stroma and tumor luminal areas.

A study was conducted to clarify the impact of variable tumor region areas and stromal/cell cycle gene expression on recurrence risk. RNA was extracted from different regions of colon tumors—the luminal part of the tumor and the tumor-associated stroma. FIG. 14 shows that there are higher expression levels of the stromal genes in the tumor-associated stroma and higher expression levels of the cell cycle genes in the luminal part of the tumor. It is therefore likely that the stroma is contributing significantly to the stromal group score (SG or SGS) and the epithelia is significantly contributing to the cell cycle gene score (CCG or CCGS). Given these assumptions, the area of stroma within the sample contributes to the variability of the SG (within and between blocks) and therefore the score(s). Similarly, the area of epithelia within the sample analyzed could contribute to the variability of the CCG (within and between blocks) and therefore the score(s).

Figure 15:
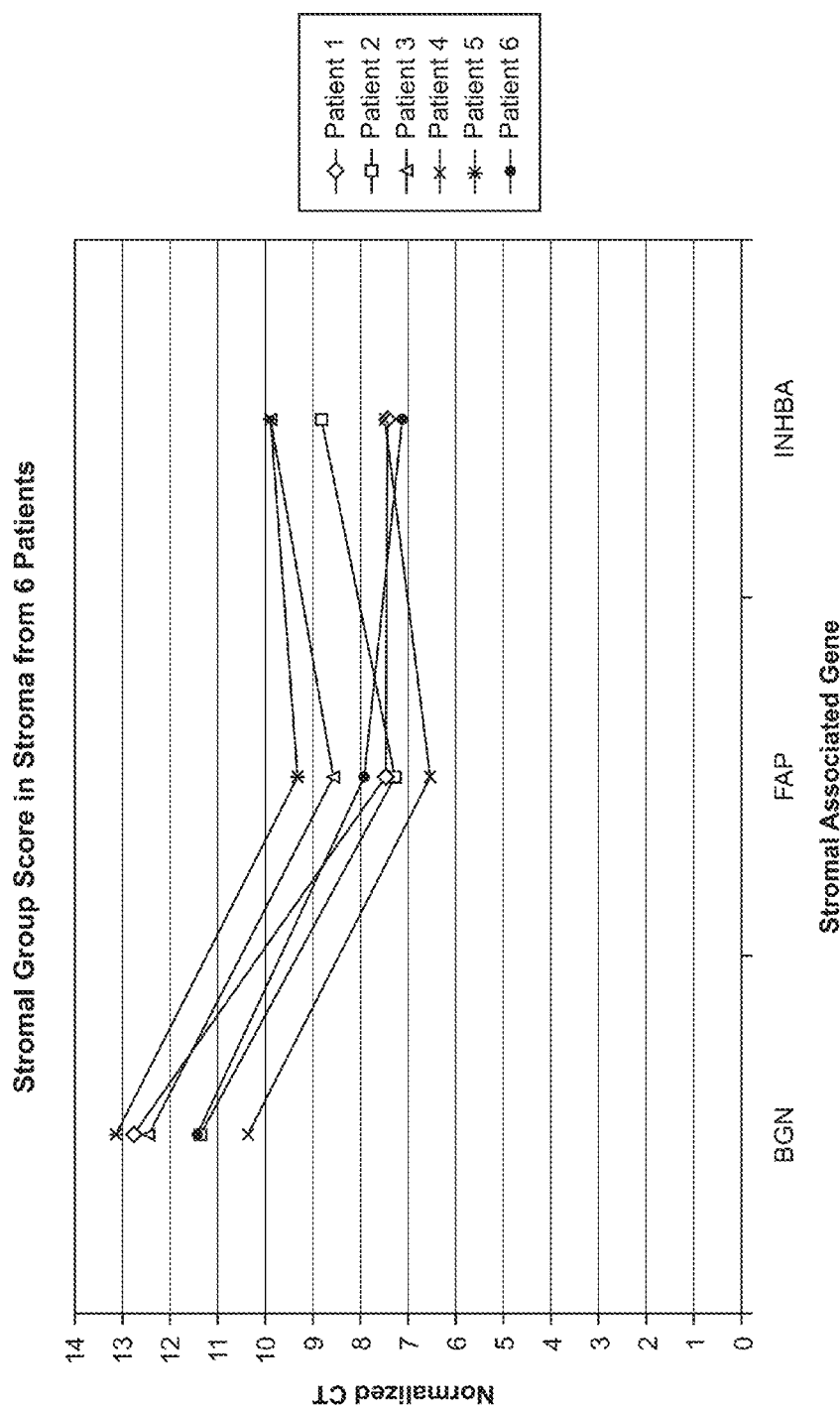
FIG. 15 is a graph showing results of analysis of stromal group score in tumor-associated stroma in six patients.
Figure 16:
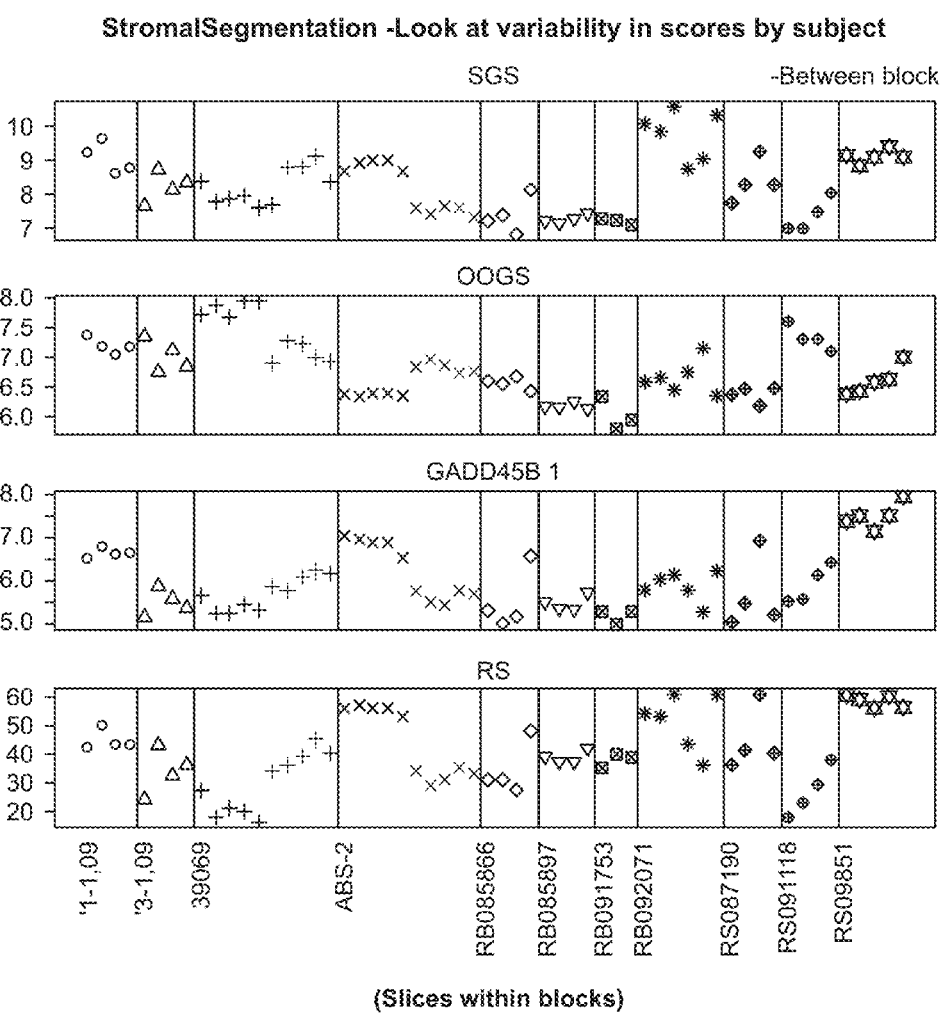
FIG. 16 is a graph showing results of analysis of variability of stromal group and cell cycle group scores, GADD45B, and RS between tumor sections taken from 11 patient blocks.

Gene expression within tumor epithelia cells and stroma varies from patient to patient. For example, FIG. 15 demonstrates that some patients may have higher levels of gene expression in their tumor-associated stroma for stromal genes than do other patients. Thus, some patients can have large amounts of stroma but low activity, whereas other patients can have smaller amounts of stroma but high activity. In addition, gene expression levels for the same patient can vary depending on the location of the tumor (e.g., within and between tumor blocks). This variability can impact reproducibility of recurrence and treatment scores for a patient. For example, FIG. 16 demonstrates the variability, by tissue section of the same tumor block, of stromal group score (SG), cell cycle group score CCG), cell signaling group (CSG or GADD45B), and recurrence score (RS). This analysis was done on multiple sections from the same tumor block, and included data from 11 patients.

Therefore, taking into account the area of the tumor-associated stroma and the area of the tumor-luminal regions in calculating the RS algorithm and in calculating the TS algorithm can enhance the reproducibility of the RS and TS, respectively, thus leading to greater accuracy of recurrence risk prediction.

For example, the expression level of stromal group genes can be provided as a ratio of the expression level of one or more stromal group genes to the tumor-associated stroma unit area ("sua") assayed. In another example, the expression level of cell cycle group genes can be provided as a ratio of the expression level of one or more cell cycle group genes to the tumor epithelial unit area ("cua") are assayed. The RS algorithm could be modified in the following form: RS= [(SG×sua coefficient)±(CCG×sua coefficient)]+[(SG×cua coefficient)±(CCG×cua coefficient)]±(repeat analysis for other gene groups, e.g., CSG, AG, and/or TFG). Similarly, the TS algorithm could be modified in the following form: TS=[(SG×sua coefficient)±(CCG×sua coefficient)]+[(SG× cua coefficient)±(CCG×cua coefficient)]±(repeat analysis for other gene groups, e.g., AG, TFG, and/or MG.)

In addition, the following exemplary algorithm provides a method to analyze and remove variability associated with gene expression in different portions of the block. For example, for cell cycle and stromal gene expression in different portions of a tumor block one could calculate: SGSij=SGi+SBij (Stromal gene group value for subject i block j is sum of a Gene effect and a Block effect) and CCGSij=CCGi+CCBij (Cell cycle gene group value for subject i block j is sum of a Gene effect and a Block effect).

SGS and CCGS are not correlated across subjects: SGS and CCGS variability is mostly from SG and CCG, the gene expression factor, and these are not correlated.

SGS and CCGS are correlated within subjects: There is a common effect underlying CCB and SB. Calculate: SGSrij=SGSij−SGSi=SBij−SBi.

$$CCGSrij=CCGSij-CCGSi.=CCBij-CCBi.$$

Correlation between SGSrij and CCGSrij can be thought of as a within subjects correlation pooled across subjects, i.e. an average within patient correlation. An informal approach to estimating ρ in (Yij, Xij)~N((μyi, μxi), [σy, ρyx//ρyx, σx]). Alternatively could assume Yij=αi+βXij+εij If % Stroma correlates with the SGS within subject, it could provide a means of removing this source of variability in the RS and/or TS values.

EXAMPLE 8

Stromal Risk Analysis

Methods and Materials

A study involving 444 patients from a subset of the Cleveland Clinic Foundation (CCF) cohort described in Example 1 was conducted to clarify how the amount of tumor-associated stroma ("stroma area") in a colon cancer tumor sample impacts the recurrence risk for stage II/III colon cancer patients ("Stromal Risk"). Specifically, a subset of the CCF cohort (cohort-sampling study design) involving all 148 recurrences from the CCF cohort and a random sample of approximately twice as many (i.e., 296) non-recurrences was used, resulting in 444 patients treated by resection of the colon.

Inclusion criteria included:
Either stage II or stage III colon cancer patient.
Patient treated with colon resection (surgery) at CCF between the years of 1981 and 2000.
Exclusion criteria included:
No tumor block available from initial diagnosis in the CCF archive.
No tumor or very little tumor (<5% of the area occupied by invasive cancer cells compared to the area occupied by other epithelial elements, such as normal epithelium, or lymphatic) in block as assessed by examination of the H&E slide by the CCF and Genomic Health Pathologist.
Patients diagnosed with stage II or stage III signet ring colon cancer (WHO classification)
Insufficient RNA (<586 ng) for RT-PCR analysis.
Average non-normalized CT for the 5 reference genes≥35.
The full CCF cohort included a total of 886 FPE tumor tissue blocks. Of these, 108 were excluded due to failure to satisfy pathology and/or laboratory requirements described below. An additional 13 patients were excluded after the laboratory, pathology and clinical data were merged because of failure to satisfy all study inclusion and exclusion criteria, leaving 765 evaluable patients. The initial histological assessment by a Genomic Health pathologist was to evaluate the slide for the quantity of tumor and, where necessary, mark for manual micro dissection to enrich the tumor region. In this initial pathology review 8 cases were found to have insufficient tumor tissue (<5% tumor tissue) and thus failed the initial pathology review. The samples then underwent full histology review. Grade was captured by CCF and Genomic Health pathologists and each pathology read was analyzed separately (i.e. no attempt was made to create a 'combined' pathology score). An additional 11 cases failed this full pathology review due to the presence of a signet ring morphology comprising greater than 50% of the invasive component, lack of sufficient invasive tumor tissue (<5% cancer cells) or tissue type other than colon. Patient and sample disposition from the CCF study are summarized in Table 11.

TABLE 11

Patient Disposition from CCF Study

| Category | N Patients | % Patients |
|---|---|---|
| Patients with available blocks | 886 | 100% |
| Excluded due to: | 121 | 13.7% |
| Failed pathology review | 18 | 2.0% |
| Insufficient RNA | 73 | 8.2% |
| QC of RT-PCR (incomplete or poor data quality) | 17 | 1.9% |
| Failure to satisfy all clinical eligibility criteria* | 13 | 1.5% |
| Evaluable patients | 765 | 86.3% |

All 444 evaluable samples underwent both standard and digital pathology assessments. Using the 120-slide capacity ScanScope XT system, automated scanning of all study H&E slides were conducted at 20× scanning magnification with autopopulation of patient identification fields with barcode data using the Spectrum information management system. The 20× scanning magnification was selected because this magnification gives superior optimization of image quality and scanning speed.

Digital H&E scans were obtained from the Aperio® Digital Pathology System. Two different software systems— the Aperio® Genie Digital Pathology Image Analysis software and the Definiens® Digital Pathology Image Analysis software—were used to generate digital H&E measurements. The Definiens image analysis software, based on the Definiens Cognition Network Technology®, examines pixels in context and builds up a picture iteratively, recognizing groups of pixels as objects.

The pathologist and assistant trained the image analysis applications to detect regions of interest (e.g., mucin, tumor glands and tumor stroma) using previously captured digital images of the entire enriched tumor portion. These training slides were representative of the slides to be assessed by the Aperio system. Several variations of the two image analysis algorithms were developed for low and high grade carcinomas and mucinous carcinomas. These were developed by identification of regions of interest, and then having the programs "learn" from the training slides. The resulting algorithms were applied to the entire patient cohort, analyzing the enriched tumor portions of the patient samples. The patient samples were batched into three digital study sets (i.e., low grade, high grade and mucinous carcinomas) as determined by the GHI pathologist and all images were processed using batch processing.

Findings and Statistical Analysis

Figure 21:
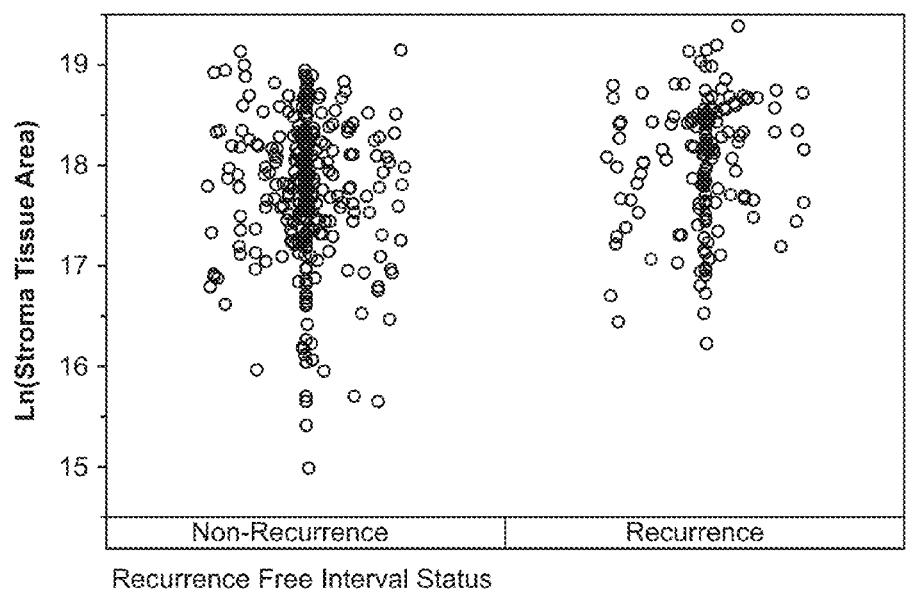
FIG. 21 is a variability plot for natural logarithm of stroma area for 444 colon cancer patients.

The surface area of tumor-associated stroma varies from patient to patient. For example, FIG. 21 provides a variability plot for natural logarithm of stroma area, as measured by the Aperio digital pathology system, for the 444 patients under study, stratified by recurrence-free interval status.

Statistical analyses were performed to determine if there was a significant relationship between stroma area and recurrence-free interval (RFI) Specifically, we compared the (reduced) Weighted Cox Proportional Hazards model for RFI based on the main effect for tumor stage (Stage II and Stage III), versus the (full) Weighted Cox Proportional Hazards model for RFI based on the main effects of tumor stage and stroma area as measured by the Aperio digital image analysis system. Weighted Pseudo Partial Likelihood approach was used to accommodate the use of a case-cohort sampling study design. A Wald test for the hypothesis that the hazard ratio for stroma area is 1 versus the 2-sided alternative hypothesis that the hazard ratio is not 1 was performed. The resulting Wald $\chi^2$=15.64 with 1 degree of freedom resulting in a 2-sided p-value <0.001, indicating that stroma area is prognostic of disease recurrence (beyond tumor stage alone) in colon cancer patients treated with colon resection. The resulting standardized hazard ratio for stroma area is 1.45, indicating that there is a 45% increase in the relative risk for disease recurrence for each standard deviation increase in stroma area.

TABLE 12

Proportional Hazard Regression for Recurrence-Free Interval: Stage and Stroma Area Alone
PH Regression on RFI for Stage, Stroma Area Alone

| Variable | Coef | Robust SE | HR | HR 95% CI | DF | Wald ChiSq | P value |
|---|---|---|---|---|---|---|---|
| Stage (III vs II) | 0.66 | 0.19 | 1.94 | (1.34, 2.82) | 1 | 12.27 | <.001 |
| Standard Area - Stroma Area, Aperio | 0.37 | 0.09 | 1.45 | (1.20, 1.74) | 1 | 15.64 | <.001 |

In addition to testing if stroma area is prognostic of disease recurrence, statistical analyses were performed to determine if stroma area provides additional prognostic information beyond both stage and Recurrence Score. Specifically, we compared the (reduced) Weighted Cox Proportional Hazards model for RFI based on the main effect for stage (Stage II and Stage III) and Recurrence Score, versus the (full) Weighted Cox Proportional Hazards model for RFI based on the main effects of tumor stage, Recurrence Score and stroma area as measured by the Aperio digital image analysis system. A Wald test for the hypothesis that the hazard ratio for stroma area is 1 versus the 2-sided alternative hypothesis that the hazard ratio is not 1 was performed. The resulting Wald ratio $\chi^2$=13.17 with 1 degree of freedom resulting in a 2-sided p-value <0.001, indicating that stroma area is prognostic of disease recurrence beyond tumor stage and Recurrence Score. The resulting standardized hazard ratio for stroma area is 1.41, indicating that there is a 41% increase in the relative risk for disease recurrence for each standard deviation increase in stroma area.

TABLE 13

Proportional Hazard Regression for Recurrence-Free Interval:
Stage, Stroma Area and Recurrence Score
PH Regression on RFI for Stage, Stroma Area Alone, and R2

| Variable | Coef | Robust SE | HR | HR 95% CI | DF | Wald ChiSq | P value |
|---|---|---|---|---|---|---|---|
| Stage (III vs II) | 0.65 | 0.19 | 1.88 | (1.32, 2.81) | 1 | 11.49 | <.001 |
| Standard Area - Stroma Area, Aperio | 0.34 | 0.10 | 1.44 | (1.17, 1.70) | 1 | 13.17 | <.001 |
| RS2/25 | 0.57 | 0.19 | 1.46 | (1.122, 2.55) | 1 | 9.19 | 0.002 |

Similar analyses were performed to test if stroma area provides additional prognostic information beyond both stage and RS2. Specifically, we compared the (reduced) Weighted Cox Proportional Hazards model for RFI based on the main effect for stage (Stage II and Stage III) and RS2, versus the (full) Weighted Cox Proportional Hazards model for RFI based on the main effects of tumor stage, RS2 and stroma area as measured by the Aperio digital image analysis system. A Wald test for the hypothesis that the hazard ratio for stroma area is 1 versus the 2-sided alternative hypothesis that the hazard ratio is not 1 was performed. The resulting Wald ratio $\chi^2 = 14.86$ with 1 degree of freedom resulting in a 2-sided p-value <0.001, indicating that stroma area is prognostic of disease recurrence beyond tumor stage and RS2. The resulting standardized hazard ratio for stroma area is 1.44, indicating that there is a 44% increase in the relative risk for disease recurrence for each standard deviation increase in stroma area.

TABLE 14

Proportional Hazard Regression for Recurrence-Free Interval:
Stage, Stroma Area and RS2
PH Regression on RFI for Stage, Stroma Area Alone, and RS2

| Variable | Coef | Robust SE | HR | HR 95% CI | DF | Wald ChiSq | P value |
|---|---|---|---|---|---|---|---|
| Stage (III vs II) | 0.63 | 0.19 | 1.88 | (1.29, 2.74) | 1 | 10.87 | <.001 |
| Standard Area - Stroma Area, Aperio | 0.36 | 0.09 | 1.44 | (1.19, 1.73) | 1 | 14.86 | <.001 |
| RS2/25 | 0.38 | 0.12 | 1.46 | (1.15, 1.85) | 1 | 9.79 | 0.002 |

Figure 22:
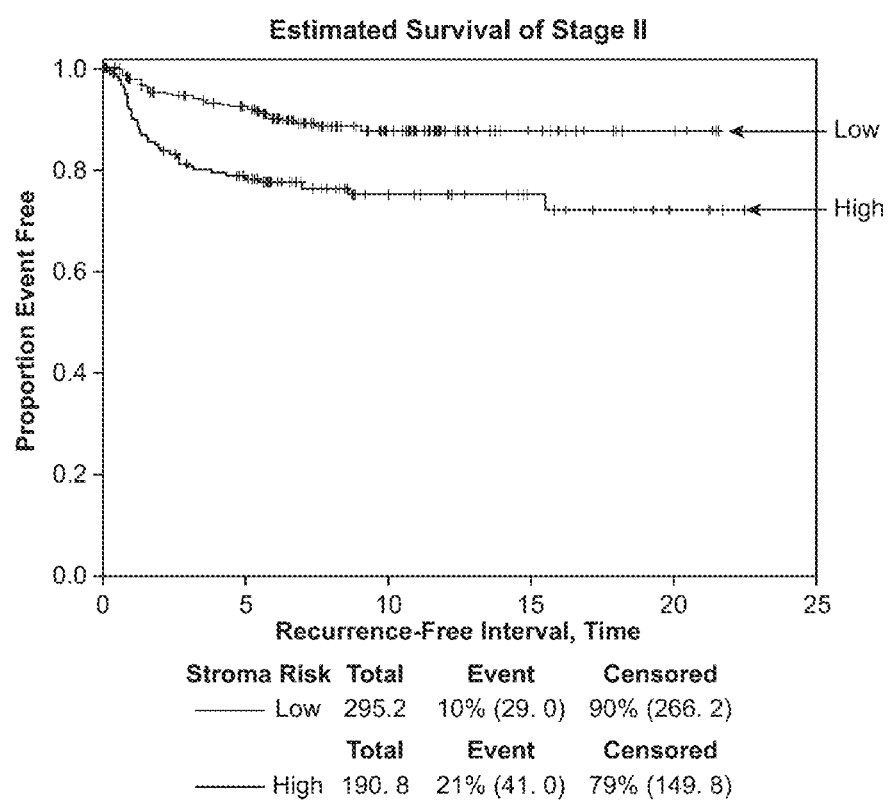
FIG. 22 is a Kaplan-Meier plot for stage II colon cancer patients stratified by stroma risk group.
Figure 23:
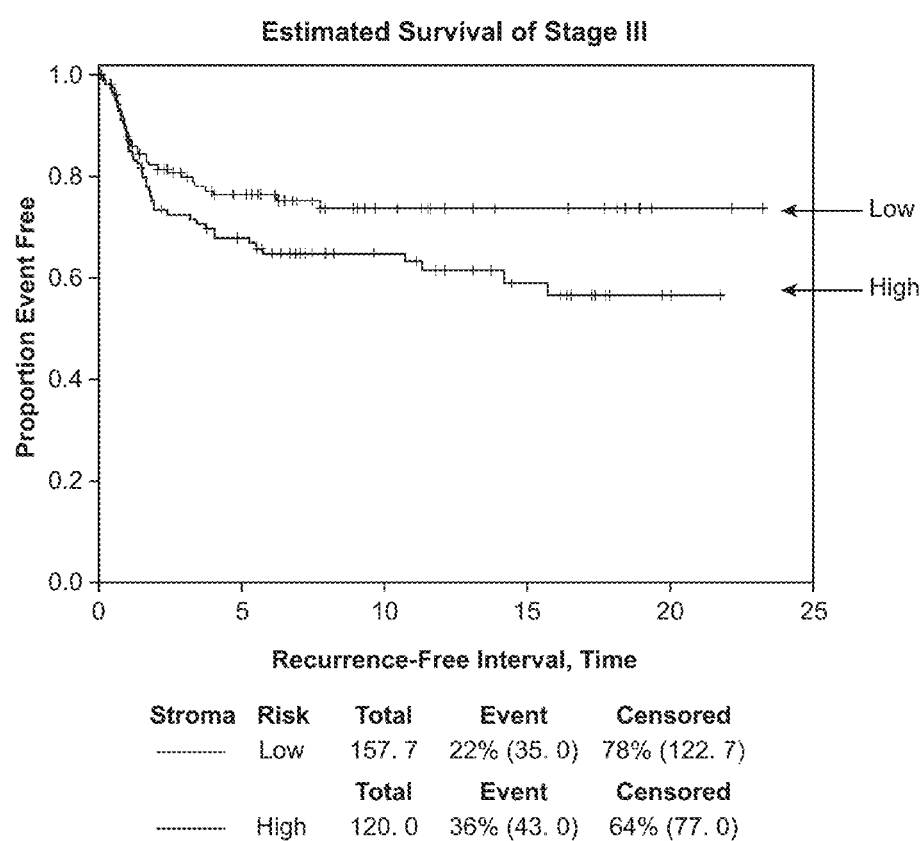
FIG. 23 is a Kaplan-Meier plot for stage III colon cancer patients stratified by stroma risk group.
Figure 24:
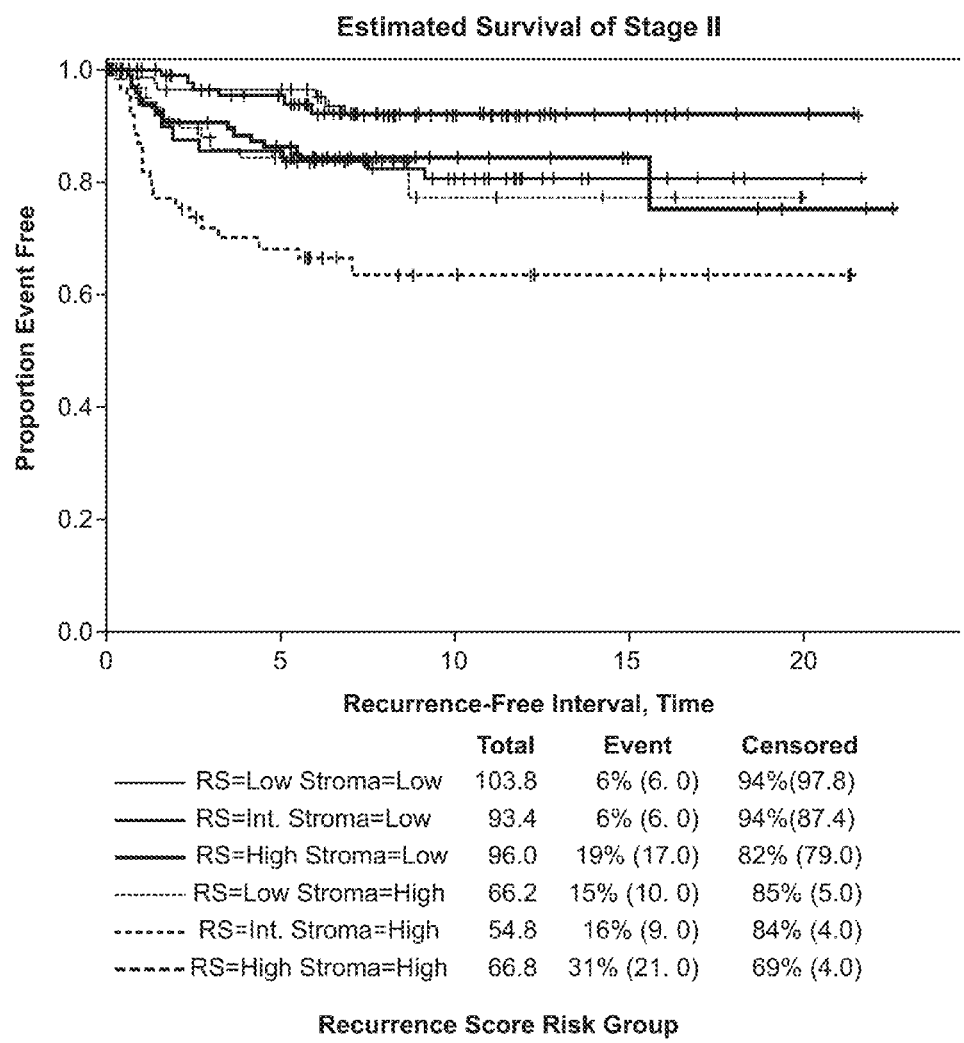
FIG. 24 provides Kaplan-Meier estimates for stage II colon cancer patients stratified by stroma risk group and recurrence score risk group.
Figure 25:
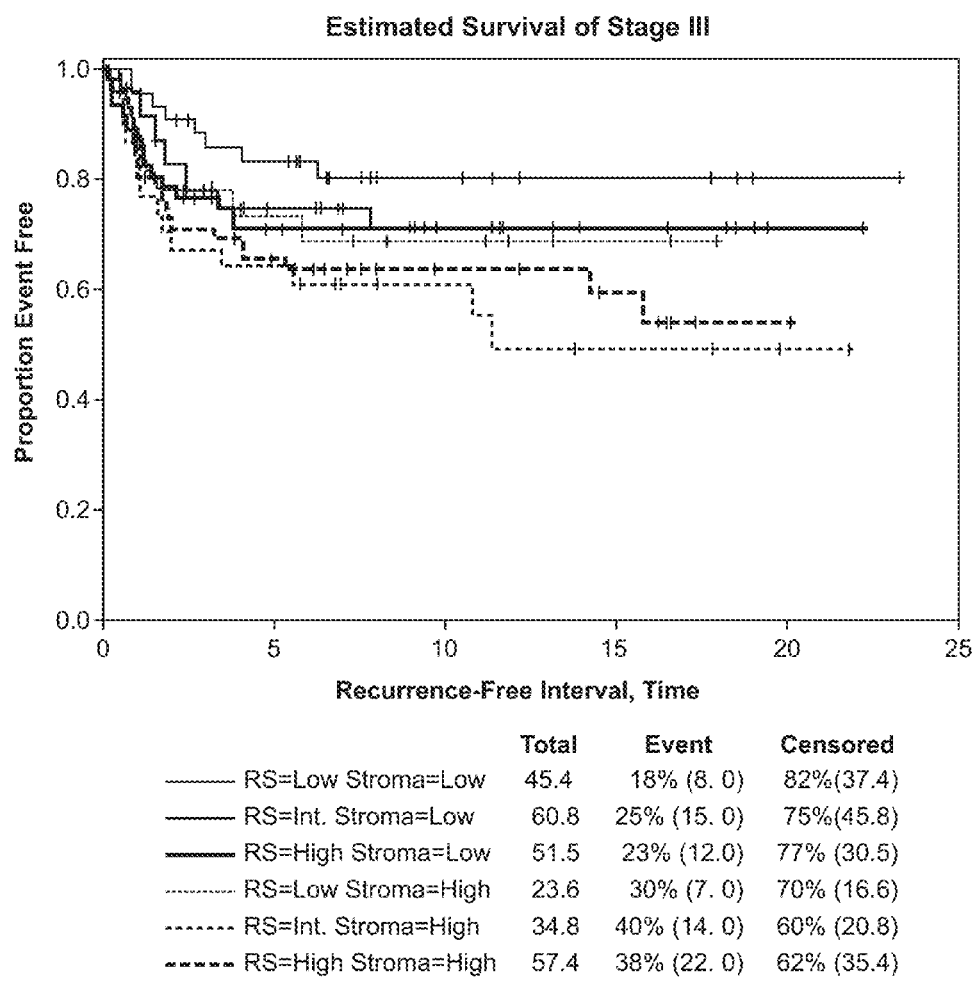
FIG. 25 provides Kaplan-Meier survival curves for stage III colon cancer patients stratified by stroma risk group and recurrence score risk group.

For analysis purposes, stroma area can be stratified into low and high Stroma Risk Groups. Specifically, we define low risk (stroma score ≤0) and high risk (stroma score >0) where stroma score=(stroma area−mean)/standard deviation. Kaplan-Meier Plots for Stage II and Stage III patients stratified by Stroma Risk Group, provided in FIGS. 22 and 23 respectively, clearly show separation between risk groups (Logrank p-value <0.01). Similarly, Kaplan-Meier Plots for Stage II and Stage III patients stratified by both Stroma Risk Group and Recurrence Score Risk Group, provided in FIGS. 24 and 25 respectively, show even greater separation between risk groups (Logrank p-value <0.01).

CONCLUSION

These analyses show that stroma area is independently prognostic of disease recurrence in stage II and stage III patients and that RS, stromal area, and nodal status all provide important prognostic information in stage II and III colon cancer. The discovery that it is surface area of tumor-associated stroma that is most strongly associated with risk of recurrence, rather that proportional measurements of tumor regions, was an unexpected result of this study.

TABLE A

| Gene | Accession | Reagt | Sequence | SEQ ID NO |
|---|---|---|---|---|
| A-Catenin | NM_001903.1 | FPr | CGTTCCGATCCTCTATACTGCAT | SEQ ID NO: 1 |
| | | Probe | ATGCCTACAGCACCCTGATGTCGCA | SEQ ID NO: 2 |
| | | RPr | AGGTCCCTGTTGGCCTTATAGG | SEQ ID NO: 3 |

TABLE A-continued

| Gene | Accession | Reagt | Sequence | SEQ ID NO |
|---|---|---|---|---|
| ABCB1 | NM_000927.2 | FPr | AAACACCACTGGAGCATTGA | SEQ ID NO: 4 |
| | | Probe | CTCGCCAATGATGCTGCTCAAGTT | SEQ ID NO: 5 |
| | | RPr | CAAGCCTGGAACCTATAGCC | SEQ ID NO: 6 |
| ABCC5 | NM_005688.1 | FPr | TGCAGACTGTACCATGCTGA | SEQ ID NO: 7 |
| | | Probe | CTGCACACGGTTCTAGGCTCCG | SEQ ID NO: 8 |
| | | RPr | GGCCAGCACCATAATCCTAT | SEQ ID NO: 9 |
| ABCC6 | NM_001171.2 | FPr | GGATGAACCTCGACCTGC | SEQ ID NO: 10 |
| | | Probe | CCAGATAGCCTCGTCCGAGTGCTC | SEQ ID NO: 11 |
| | | RPr | GAGCTGCACCGTCTCCAG | SEQ ID NO: 12 |
| ACP1 | NM_004300.2 | FPr | GCTACCAAGTCCGTGCTGT | SEQ ID NO: 13 |
| | | Probe | TGATCGACAAATGTTACCCAGACACA | SEQ ID NO: 14 |
| | | RPr | GAAAACTGCTTCTGCAATGG | SEQ ID NO: 15 |
| ADAM10 | NM_001110.1 | FPr | CCCATCAACTTGTGCCAGTA | SEQ ID NO: 16 |
| | | Probe | TGCCTACTCCACTGCACAGACCCT | SEQ ID NO: 17 |
| | | RPr | GGTGATGGTTCGACCACTG | SEQ ID NO: 18 |
| ADAM17 | NM_003183.3 | FPr | GAAGTGCCAGGAGGCGATTA | SEQ ID NO: 19 |
| | | Probe | TGCTACTTGCAAAGGCGTGTCCTACTGC | SEQ ID NO: 20 |
| | | RPr | CGGGCACTCACTGCTATTACC | SEQ ID NO: 21 |
| ADAMTS12 | NM_030955.2 | FPr | GGAGAAGGGTGGAGTGCAG | SEQ ID NO: 22 |
| | | Probe | CGCACAGTCAGAATCCATCTGGGT | SEQ ID NO: 23 |
| | | RPr | CAGGGTCAGGTCTCTGGATG | SEQ ID NO: 24 |
| ADPRT | NM_001618.2 | FPr | TTGACAACCTGCTGGACATC | SEQ ID NO: 25 |
| | | Probe | CCCTGAGCAGACTGTAGGCCACCT | SEQ ID NO: 26 |
| | | RPr | ATGGGATCCTTGCTGCTATC | SEQ ID NO: 27 |
| AGXT | NM_000030.1 | FPr | CTTTTCCCTCCAGTGGCA | SEQ ID NO: 28 |
| | | Probe | CTCCTGGAAACAGTCCACTTGGGC | SEQ ID NO: 29 |
| | | RPr | ATTTGGAAGGCACTGGGTTT | SEQ ID NO: 30 |
| AKAP12 | NM_005100.2 | FPr | TAGAGAGCCCCTGACAATCC | SEQ ID NO: 31 |
| | | Probe | TGGCTCTAGCTCCTGATGAAGCCTC | SEQ ID NO: 32 |
| | | RPr | GGTTGGTCTTGGAAAGAGGA | SEQ ID NO: 33 |
| AKT1 | NM_005163.1 | FPr | CGCTTCTATGGCGCTGAGAT | SEQ ID NO: 34 |
| | | Probe | CAGCCCTGGACTACCTGCACTCGG | SEQ ID NO: 35 |
| | | RPr | TCCCGGTACACCACGTTCTT | SEQ ID NO: 36 |
| AKT2 | NM_001626.2 | FPr | TCCTGCCACCCTTCAAACC | SEQ ID NO: 37 |
| | | Probe | CAGGTCACGTCCGAGGTCGACACA | SEQ ID NO: 38 |
| | | RPr | GGCGGTAAATTCATCATCGAA | SEQ ID NO: 39 |
| AKT3 | NM_005465.1 | FPr | TTGTCTCTGCCTTGGACTATCTACA | SEQ ID NO: 40 |
| | | Probe | TCACGGTACACAATCTTTCCGGA | SEQ ID NO: 41 |
| | | RPr | CCAGCATTAGATTCTCCAACTTGA | SEQ ID NO: 42 |
| AL137428 | AL137428.1 | FPr | CAAGAAGAGGCTCTACCCTGG | SEQ ID NO: 43 |
| | | Probe | ACTGGGAATTTCCAAGGCCACCTT | SEQ ID NO: 44 |
| | | RPr | AAATGAGCTCTGCGATCCTC | SEQ ID NO: 45 |
| ALCAM | NM_001627.1 | FPr | GAGGAATATGGAATCCAAGGG | SEQ ID NO: 46 |
| | | Probe | CCAGTTCCTGCCGTCTGCTCTTCT | SEQ ID NO: 47 |
| | | RPr | GTGGCGGAGATCAAGAGG | SEQ ID NO: 48 |
| ALDH1A1 | NM_000689.1 | FPr | GAAGGAGATAAGGAGGATGTTGACA | SEQ ID NO: 49 |
| | | Probe | AGTGAAGGCCGCAAGACAGGCTTTTC | SEQ ID NO: 50 |
| | | RPr | CGCCACGGAGATCCAATC | SEQ ID NO: 51 |
| ALDOA | NM_000034.2 | FPr | GCCTGTACGTGCCAGCTC | SEQ ID NO: 52 |
| | | Probe | TGCCAGAGCCTCAACTGTCTCTGC | SEQ ID NO: 53 |
| | | RPr | TCATCGGAGCTTGATCTCG | SEQ ID NO: 54 |
| AMFR | NM_001144.2 | FPr | GATGGTTCAGCTCTGCAAGGA | SEQ ID NO: 55 |
| | | Probe | CGATTTGAAATATCTTTCCTTCTCGCCCACC | SEQ ID NO: 56 |
| | | RPr | TCGACCGTGGCTGCTCAT | SEQ ID NO: 57 |
| ANGPT2 | NM_001147.1 | FPr | CCGTGAAAGCTGCTCTGTAA | SEQ ID NO: 58 |
| | | Probe | AAGCTGACACAGCCCTCCCAAGTG | SEQ ID NO: 59 |
| | | RPr | TTGCAGTGGGAAGAACAGTC | SEQ ID NO: 60 |

TABLE A-continued

| Gene | Accession | Reagt | Sequence | SEQ ID NO |
|---|---|---|---|---|
| ANTXR1 | NM_032208.1 | FPr | CTCCAGGTGTACCTCCAACC | SEQ ID NO: 61 |
| | | Probe | AGCCTTCTCCCACAGCTGCCTACA | SEQ ID NO: 62 |
| | | RPr | GAGAAGGCTGGGAGACTCTG | SEQ ID NO: 63 |
| ANXA1 | NM_000700.1 | FPr | GCCCCTATCCTACCTTCAATCC | SEQ ID NO: 64 |
| | | Probe | TCCTCGGATGTCGCTGCCT | SEQ ID NO: 65 |
| | | RPr | CCTTTAACCATTATGGCCTTATGC | SEQ ID NO: 66 |
| ANXA2 | NM_004039.1 | FPr | CAAGACACTAAGGGCGACTACCA | SEQ ID NO: 67 |
| | | Probe | CCACCACACAGGTACAGCAGCGCT | SEQ ID NO: 68 |
| | | RPr | CGTGTCGGGCTTCAGTCAT | SEQ ID NO: 69 |
| ANXA5 | NM_001154.2 | FPr | GCTCAAGCCTGGAAGATGAC | SEQ ID NO: 70 |
| | | Probe | AGTACCCTGAAGTGTCCCCCACCA | SEQ ID NO: 71 |
| | | RPr | AGAACCACCAACATCCGCT | SEQ ID NO: 72 |
| AP-1 (JUN official) | NM_002228.2 | FPr | GACTGCAAAGATGGAAACGA | SEQ ID NO: 73 |
| | | Probe | CTATGACGATGCCCTCAACGCCTC | SEQ ID NO: 74 |
| | | RPr | TAGCCATAAGGTCCGCTCTC | SEQ ID NO: 75 |
| APC | NM_000038.1 | FPr | GGACAGCAGGAATGTGTTTC | SEQ ID NO: 76 |
| | | Probe | CATTGGCTCCCCGTGACCTGTA | SEQ ID NO: 77 |
| | | RPr | ACCCACTCGATTTGTTTCTG | SEQ ID NO: 78 |
| APEX-1 | NM_001641.2 | FPr | GATGAAGCCTTTCGCAAGTT | SEQ ID NO: 79 |
| | | Probe | CTTTCGGGAAGCCAGGCCTT | SEQ ID NO: 80 |
| | | RPr | AGGTCTCCACACAGCACAAG | SEQ ID NO: 81 |
| APG-1 | NM_014278.2 | FPr | ACCCCGGCCTGTATATCAT | SEQ ID NO: 82 |
| | | Probe | CCAATGGCTCGAGTTCTTGATCCC | SEQ ID NO: 83 |
| | | RPr | CTATCTGGCTCTTTGCTGCAT | SEQ ID NO: 84 |
| APN (ANPEP official) | NM_001150.1 | FPr | CCACCTTGGACCAAAGTAAAGC | SEQ ID NO: 85 |
| | | Probe | CTCCCCAACACGCTGAAACCCG | SEQ ID NO: 86 |
| | | RPr | TCTCAGCGTCACCTGGTAGGA | SEQ ID NO: 87 |
| APOC1 | NM_001645.3 | FPr | GGAAACACACTGGAGGACAAG | SEQ ID NO: 88 |
| | | Probe | TCATCAGCCGCATCAAACAGAGTG | SEQ ID NO: 89 |
| | | RPr | CGCATCTTGGCAGAAAGTT | SEQ ID NO: 90 |
| AREG | NM_001657.1 | FPr | TGTGAGTGAAATGCCTTCTAGTAGTGA | SEQ ID NO: 91 |
| | | Probe | CCGTCCTCGGGAGCCGACTATGA | SEQ ID NO: 92 |
| | | RPr | TTGTGGTTCGTTATCATACTCTTCTGA | SEQ ID NO: 93 |
| ARG | NM_005158.2 | FPr | CGCAGTGCAGCTGAGTATCTG | SEQ ID NO: 94 |
| | | Probe | TCGCACCAGGAAGCTGCCATTGA | SEQ ID NO: 95 |
| | | RPr | TGCCCAGGGCTACTCTCACTT | SEQ ID NO: 96 |
| ARHF | NM_019034.2 | FPr | ACTGGCCCACTTAGTCCTCA | SEQ ID NO: 97 |
| | | Probe | CTCCCAACCTGCTGTCCCTCAAG | SEQ ID NO: 98 |
| | | RPr | CTGAACTCCACAGGCTGGTA | SEQ ID NO: 99 |
| ATOH1 | NM_005172.1 | FPr | GCAGCCACCTGCAACTTT | SEQ ID NO: 100 |
| | | Probe | CAGGCGAGAGAGCATCCCGTCTAC | SEQ ID NO: 101 |
| | | RPr | TCCAGGAGGGACAGCTCA | SEQ ID NO: 102 |
| ATP5A1 | NM_004046.3 | FPr | GATGCTGCCACTCAACAACT | SEQ ID NO: 103 |
| | | Probe | AGTTAGACGCACGCCACGACTCAA | SEQ ID NO: 104 |
| | | RPr | TGTCCTTGCTTCAGCAACTC | SEQ ID NO: 105 |
| ATP5E | NM_006886.2 | FPr | CCGCTTTCGCTACAGCAT | SEQ ID NO: 106 |
| | | Probe | TCCAGCCTGTCTCCAGTAGGCCAC | SEQ ID NO: 107 |
| | | RPr | TGGGAGTATCGGATGTAGCTG | SEQ ID NO: 108 |
| AURKB | NM_004217.1 | FPr | AGCTGCAGAAGAGCTGCACAT | SEQ ID NO: 109 |
| | | Probe | TGACGAGCAGCGAACAGCCACG | SEQ ID NO: 110 |
| | | RPr | GCATCTGCCAACTCCTCCAT | SEQ ID NO: 111 |
| Axin 2 | NM_004655.2 | FPr | GGCTATGTCTTTGCACCAGC | SEQ ID NO: 112 |
| | | Probe | ACCAGCGCCAACGACAGTGAGATA | SEQ ID NO: 113 |
| | | RPr | ATCCGTCAGCGCATCACT | SEQ ID NO: 114 |
| axin1 | NM_003502.2 | FPr | CCGTGTGACAGCATCGTT | SEQ ID NO: 115 |
| | | Probe | CGTACTACTTCTGCGGGGAACCCA | SEQ ID NO: 116 |
| | | RPr | CTCACCAGGGTGCGGTAG | SEQ ID NO: 117 |

TABLE A-continued

| Gene | Accession | Reagt | Sequence | SEQ ID NO |
|---|---|---|---|---|
| B-Catenin | NM_001904.1 | FPr | GGCTCTTGTGCGTACTGTCCTT | SEQ ID NO: 118 |
| | | Probe | AGGCTCAGTGATGTCTTCCCTGTCACCAG | SEQ ID NO: 119 |
| | | RPr | TCAGATGACGAAGAGCACAGATG | SEQ ID NO: 120 |
| BAD | NM_032989.1 | FPr | GGGTCAGGTGCCTCGAGAT | SEQ ID NO: 121 |
| | | Probe | TGGGCCCAGAGCATGTTCCAGATC | SEQ ID NO: 122 |
| | | RPr | CTGCTCACTCGGCTCAAACTC | SEQ ID NO: 123 |
| BAG1 | NM_004323.2 | FPr | CGTTGTCAGCACTTGGAATACAA | SEQ ID NO: 124 |
| | | Probe | CCCAATTAACATGACCCGGCAACCAT | SEQ ID NO: 125 |
| | | RPr | GTTCAACCTCTTCCTGTGGACTGT | SEQ ID NO: 126 |
| BAG2 | NM_004282.2 | FPr | CTAGGGGCAAAAAGCATGA | SEQ ID NO: 127 |
| | | Probe | TTCCATGCCAGACAGGAAAAAGCA | SEQ ID NO: 128 |
| | | RPr | CTAAATGCCCAAGGTGACTG | SEQ ID NO: 129 |
| BAG3 | NM_004281.2 | FPr | GAAAGTAAGCCAGGCCCAGTT | SEQ ID NO: 130 |
| | | Probe | CAGAACTCCCTCCTGGACACATCCCAA | SEQ ID NO: 131 |
| | | RPr | ACCTCTTTGCGGATCACTTGA | SEQ ID NO: 132 |
| Bak | NM_001188.1 | FPr | CCATTCCCACCATTCTACCT | SEQ ID NO: 133 |
| | | Probe | ACACCCCAGACGTCCTGGCCT | SEQ ID NO: 134 |
| | | RPr | GGGAACATAGACCCACCAAT | SEQ ID NO: 135 |
| Bax | NM_004324.1 | FPr | CCGCCGTGGACACAGACT | SEQ ID NO: 136 |
| | | Probe | TGCCACTCGGAAAAAGACCTCTCGG | SEQ ID NO: 137 |
| | | RPr | TTGCCGTCAGAAAACATGTCA | SEQ ID NO: 138 |
| BBC3 | NM_014417.1 | FPr | CCTGGAGGGTCCTGTACAAT | SEQ ID NO: 139 |
| | | Probe | CATCATGGGACTCCTGCCCTTACC | SEQ ID NO: 140 |
| | | RPr | CTAATTGGGCTCCATCTCG | SEQ ID NO: 141 |
| BCAS1 | NM_003657.1 | FPr | CCCCGAGACAACGGAGATAA | SEQ ID NO: 142 |
| | | Probe | CTTTCCGTTGGCATCCGCAACAG | SEQ ID NO: 143 |
| | | RPr | CTCGGGTTTGGCCTCTTTC | SEQ ID NO: 144 |
| Bcl2 | NM_000633.1 | FPr | CAGATGGACCTAGTACCCACTGAGA | SEQ ID NO: 145 |
| | | Probe | TTCCACGCCGAAGGACAGCGAT | SEQ ID NO: 146 |
| | | RPr | CCTATGATTTAAGGGCATTTTTCC | SEQ ID NO: 147 |
| BCL2L10 | NM_020396.2 | FPr | GCTGGGATGGCTTTTGTCA | SEQ ID NO: 148 |
| | | Probe | TCTTCAGGACCCCCTTTCCACTGGC | SEQ ID NO: 149 |
| | | RPr | GCCTGGACCAGCTGTTTTCTC | SEQ ID NO: 150 |
| BCL2L11 | NM_138621.1 | FPr | AATTACCAAGCAGCCGAAGA | SEQ ID NO: 151 |
| | | Probe | CCACCCACGAATGGTTATCTTACGACTG | SEQ ID NO: 152 |
| | | RPr | CAGGCGGACAATGTAACGTA | SEQ ID NO: 153 |
| BCL2L12 | NM_138639.1 | FPr | AACCCACCCCTGTCTTGG | SEQ ID NO: 154 |
| | | Probe | TCCGGGTAGCTCTCAAACTCGAGG | SEQ ID NO: 155 |
| | | RPr | CTCAGCTGACGGGAAAGG | SEQ ID NO: 156 |
| Bclx | NM_001191.1 | FPr | CTTTTGTGGAACTCTATGGGAACA | SEQ ID NO: 157 |
| | | Probe | TTCGGCTCTCGGCTGCTGCA | SEQ ID NO: 158 |
| | | RPr | CAGCGGTTGAAGCGTTCCT | SEQ ID NO: 159 |
| BCRP | NM_004827.1 | FPr | TGTACTGGCGAAGAATATTTGGTAAA | SEQ ID NO: 160 |
| | | Probe | CAGGGCATCGATCTCTCACCCTGG | SEQ ID NO: 161 |
| | | RPr | GCCACGTGATTCTTCCACAA | SEQ ID NO: 162 |
| BFGF | NM_007083.1 | FPr | CCAGGAAGAATGCTTAAGATGTGA | SEQ ID NO: 163 |
| | | Probe | TTCGCCAGGTCATTGAGCCATCCA | SEQ ID NO: 164 |
| | | RPr | TGGTGATGGGAGTTGTATTTTCAG | SEQ ID NO: 165 |
| BGN | NM_001711.3 | FPr | GAGCTCCGCAAGGATGAC | SEQ ID NO: 166 |
| | | Probe | CAAGGGTCTCCAGCACCTCTACGC | SEQ ID NO: 167 |
| | | RPr | CTTGTTGTTCACCAGGACGA | SEQ ID NO: 168 |
| BID | NM_001196.2 | FPr | GGACTGTGAGGTCAACAACG | SEQ ID NO: 169 |
| | | Probe | TGTGATGCACTCATCCCTGAGGCT | SEQ ID NO: 170 |
| | | RPr | GGAAGCCAAACACCAGTAGG | SEQ ID NO: 171 |
| BIK | NM_001197.3 | FPr | ATTCCTATGGCTCTGCAATTGTC | SEQ ID NO: 172 |
| | | Probe | CCGGTTAACTGTGGCCTGTGCCC | SEQ ID NO: 173 |
| | | RPr | GGCAGGAGTGAATGGCTCTTC | SEQ ID NO: 174 |

TABLE A-continued

| Gene | Accession | Reagt | Sequence | SEQ ID NO |
|---|---|---|---|---|
| BIN1 | NM_004305.1 | FPr | CCTGCAAAAGGGAACAAGAG | SEQ ID NO: 175 |
| | | Probe | CTTCGCCTCCAGATGGCTCCC | SEQ ID NO: 176 |
| | | RPr | CGTGGTTGACTCTGATCTCG | SEQ ID NO: 177 |
| BLMH | NM_000386.2 | FPr | GGTTGCTGCCTCCATCAAAG | SEQ ID NO: 178 |
| | | Probe | ACATCACAGCCAAACCACACAGCCTCT | SEQ ID NO: 179 |
| | | RPr | CCAGCTTGCTATTGAAGTGTTTTC | SEQ ID NO: 180 |
| BMP2 | NM_001200.1 | FPr | ATGTGGACGCTCTTTCAATG | SEQ ID NO: 181 |
| | | Probe | ACCGCAGTCCGTCTAAGAAGCACG | SEQ ID NO: 182 |
| | | RPr | ACCATGGTCGACCTTTAGGA | SEQ ID NO: 183 |
| BMP4 | NM_001202.2 | FPr | GGGCTAGCCATTGAGGTG | SEQ ID NO: 184 |
| | | Probe | CTCACCTCCATCAGACTCGGACCC | SEQ ID NO: 185 |
| | | RPr | GCTAATCCTGACATGCTGGC | SEQ ID NO: 186 |
| BMP7 | NM_001719.1 | FPr | TCGTGGAACATGACAAGGAATT | SEQ ID NO: 187 |
| | | Probe | TTCCACCCACGCTACCACCATCG | SEQ ID NO: 188 |
| | | RPr | TGGAAAGATCAAACCGGAACTC | SEQ ID NO: 189 |
| BMPR1A | NM_004329.2 | FPr | TTGGTTCAGCGAACTATTGC | SEQ ID NO: 190 |
| | | Probe | CAAACAGATTCAGATGGTCCGGCA | SEQ ID NO: 191 |
| | | RPr | TCTCCATATCGGCCTTTACC | SEQ ID NO: 192 |
| BRAF | NM_004333.1 | FPr | CCTTCCGACCAGCAGATGAA | SEQ ID NO: 193 |
| | | Probe | CAATTTGGGCAACGAGACCGATCCT | SEQ ID NO: 194 |
| | | RPr | TTTATATGCACATTGGGAGCTGAT | SEQ ID NO: 195 |
| BRCA1 | NM_007295.1 | FPr | TCAGGGGGCTAGAAATCTGT | SEQ ID NO: 196 |
| | | Probe | CTATGGGCCCTTCACCAACATGC | SEQ ID NO: 197 |
| | | RPr | CCATTCCAGTTGATCTGTGG | SEQ ID NO: 198 |
| BRCA2 | NM_000059.1 | FPr | AGTTCGTGCTTTGCAAGATG | SEQ ID NO: 199 |
| | | Probe | CATTCTTCACTGCTTCATAAAGCTCTGCA | SEQ ID NO: 200 |
| | | RPr | AAGGTAAGCTGGGTCTGCTG | SEQ ID NO: 201 |
| BRK | NM_005975.1 | FPr | GTGCAGGAAAGGTTCACAAA | SEQ ID NO: 202 |
| | | Probe | AGTGTCTGCGTCCAATACACGCGT | SEQ ID NO: 203 |
| | | RPr | GCACACACGATGGAGTAAGG | SEQ ID NO: 204 |
| BTF3 | NM_001207.2 | FPr | CAGTGATCCACTTTAACAACCCTAAAG | SEQ ID NO: 205 |
| | | Probe | TCAGGCATCTCTGGCAGCGAACAC | SEQ ID NO: 206 |
| | | RPr | AGCATGGCCTGTAATGGTGAA | SEQ ID NO: 207 |
| BTRC | NM_033637.2 | FPr | GTTGGGACACAGTTGGTCTG | SEQ ID NO: 208 |
| | | Probe | CAGTCGGCCCAGGACGGTCTACT | SEQ ID NO: 209 |
| | | RPr | TGAAGCAGTCAGTTGTGCTG | SEQ ID NO: 210 |
| BUB1 | NM_004336.1 | FPr | CCGAGGTTAATCCAGCACGTA | SEQ ID NO: 211 |
| | | Probe | TGCTGGGAGCCTACACTTGGCCC | SEQ ID NO: 212 |
| | | RPr | AAGACATGGCGCTCTCAGTTC | SEQ ID NO: 213 |
| BUB1B | NM_001211.3 | FPr | TCAACAGAAGGCTGAACCACTAGA | SEQ ID NO: 214 |
| | | Probe | TACAGTCCCAGCACCGACAATTCC | SEQ ID NO: 215 |
| | | RPr | CAACAGAGTTTGCCGAGACACT | SEQ ID NO: 216 |
| BUB3 | NM_004725.1 | FPr | CTGAAGCAGATGGTTCATCATT | SEQ ID NO: 217 |
| | | Probe | CCTCGCTTTGTTTAACAGCCCAGG | SEQ ID NO: 218 |
| | | RPr | GCTGATTCCCAAGAGTCTAACC | SEQ ID NO: 219 |
| c-abl | NM_005157.2 | FPr | CCATCTCGCTGAGATACGAA | SEQ ID NO: 220 |
| | | Probe | GGGAGGGTGTACCATTACAGGATCAACA | SEQ ID NO: 221 |
| | | RPr | AGACGTAGAGCTTGCCATCA | SEQ ID NO: 222 |
| c-kit | NM_000222.1 | FPr | GAGGCAACTGCTTATGGCTTAATTA | SEQ ID NO: 223 |
| | | Probe | TTACAGCGACAGTCATGGCCGCAT | SEQ ID NO: 224 |
| | | RPr | GGCACTCGGCTTGAGCAT | SEQ ID NO: 225 |
| c-myb (MYB official) | NM_005375.1 | FPr | AACTCAGACTTGGAAATGCCTTCT | SEQ ID NO: 226 |
| | | Probe | AACTTCCACCCCCCTCATTGGTCACA | SEQ ID NO: 227 |
| | | RPr | CTGGTCTCTATGAAATGGTGTTGTAAC | SEQ ID NO: 228 |
| c-Src | NM_005417.3 | FPr | TGAGGAGTGGTATTTTGGCAAGA | SEQ ID NO: 229 |
| | | Probe | AACCGCTCTGACTCCCGTCTGGTG | SEQ ID NO: 230 |
| | | RPr | CTCTCGGGTTCTCTGCATTGA | SEQ ID NO: 231 |

TABLE A-continued

| Gene | Accession | Reagt | Sequence | SEQ ID NO |
|---|---|---|---|---|
| C20 orf1 | NM_012112.2 | FPr | TCAGCTGTGAGCTGCGGATA | SEQ ID NO: 232 |
| | | Probe | CAGGTCCCATTGCCGGGCG | SEQ ID NO: 233 |
| | | RPr | ACGGTCCTAGGTTTGAGGTTAAGA | SEQ ID NO: 234 |
| C20ORF126 | NM_030815.2 | FPr | CCAGCACTGCTCGTTACTGT | SEQ ID NO: 235 |
| | | Probe | TGGGACCTCAGACCACTGAAGGC | SEQ ID NO: 236 |
| | | RPr | TTGACTTCACGGCAGTTCATA | SEQ ID NO: 237 |
| C8orf4 | NM_020130.2 | FPr | CTACGAGTCAGCCCATCCAT | SEQ ID NO: 238 |
| | | Probe | CATGGCTACCACTTCGACACAGCC | SEQ ID NO: 239 |
| | | RPr | TGCCCACGGCTTTCTTAC | SEQ ID NO: 240 |
| CA9 | NM_001216.1 | FPr | ATCCTAGCCCTGGTTTTGG | SEQ ID NO: 241 |
| | | Probe | TTTGCTGTCACCAGCGTCGC | SEQ ID NO: 242 |
| | | RPr | CTGCCTTCTCATCTGCACAA | SEQ ID NO: 243 |
| Cad17 | NM_004063.2 | FPr | GAAGGCCAAGAACCGAGTCA | SEQ ID NO: 244 |
| | | Probe | TTATATTCCAGTTTAAGGCCAATCCTC | SEQ ID NO: 245 |
| | | RPr | TCCCCAGTTAGTTCAAAAGTCACA | SEQ ID NO: 246 |
| CALD1 | NM_004342.4 | FPr | CACTAAGGTTTGAGACAGTTCCAGAA | SEQ ID NO: 247 |
| | | Probe | AACCCAAGCTCAAGACGCAGGACGAG | SEQ ID NO: 248 |
| | | RPr | GCGAATTAGCCCTCTACAACTGA | SEQ ID NO: 249 |
| CAPG | NM_001747.1 | FPr | GATTGTCACTGATGGGGAGG | SEQ ID NO: 250 |
| | | Probe | AGGACCTGGATCATCTCAGCAGGC | SEQ ID NO: 251 |
| | | RPr | CCTTCAGAGCAGGCTTGG | SEQ ID NO: 252 |
| CAPN1 | NM_005186.2 | FPr | CAAGAAGCTGTACGAGCTCATCA | SEQ ID NO: 253 |
| | | Probe | CCGCTACTCGGAGCCCGACCTG | SEQ ID NO: 254 |
| | | RPr | GCAGCAAACGAAATTGTCAAAG | SEQ ID NO: 255 |
| CASP8 | NM_033357.1 | FPr | CCTCGGGGATACTGTCTGAT | SEQ ID NO: 256 |
| | | Probe | CAACAATCACAATTTTGCAAAAGCACG | SEQ ID NO: 257 |
| | | RPr | GAAGTTTGGGCACTTTCTCC | SEQ ID NO: 258 |
| CASP9 | NM_001229.2 | FPr | TGAATGCCGTGGATTGCA | SEQ ID NO: 259 |
| | | Probe | CACTAGCCCTGGACCAGCCACTGCT | SEQ ID NO: 260 |
| | | RPr | ACAGGGATCATGGGACACAAG | SEQ ID NO: 261 |
| CAT | NM_001752.1 | FPr | ATCCATTCGATCTCACCAAGGT | SEQ ID NO: 262 |
| | | Probe | TGGCCTCACAAGGACTACCCTCTCATCC | SEQ ID NO: 263 |
| | | RPr | TCCGGTTTAAGACCAGTTTACCA | SEQ ID NO: 264 |
| CAV1 | NM_001753.3 | FPr | GTGGCTCAACATTGTGTTCC | SEQ ID NO: 265 |
| | | Probe | ATTTCAGCTGATCAGTGGGCCTCC | SEQ ID NO: 266 |
| | | RPr | CAATGGCCTCCATTTTACAG | SEQ ID NO: 267 |
| CBL | NM_005188.1 | FPr | TCATTCACAAACCTGGCAGT | SEQ ID NO: 268 |
| | | Probe | TTCCGGCTGAGCTGTACTCGTCTG | SEQ ID NO: 269 |
| | | RPr | CATACCCAATAGCCCACTGA | SEQ ID NO: 270 |
| CCL20 | NM_004591.1 | FPr | CCATGTGCTGTACCAAGAGTTTG | SEQ ID NO: 271 |
| | | Probe | CAGCACTGACATCAAAGCAGCCAGGA | SEQ ID NO: 272 |
| | | RPr | CGCCGCAGAGGTGGAGTA | SEQ ID NO: 273 |
| CCL3 | NM_002983.1 | FPr | AGCAGACAGTGGTCAGTCCTT | SEQ ID NO: 274 |
| | | Probe | CTCTGCTGACACTCGAGCCCACAT | SEQ ID NO: 275 |
| | | RPr | CTGCATGATTCTGAGCAGGT | SEQ ID NO: 276 |
| CCNA2 | NM_001237.2 | FPr | CCATACCTCAAGTATTTGCCATCAG | SEQ ID NO: 277 |
| | | Probe | ATTGCTGGAGCTGCCTTTCATTTAGCACT | SEQ ID NO: 278 |
| | | RPr | AGCTTTGTCCCGTGACTGTGTA | SEQ ID NO: 279 |
| CCNB1 | NM_031966.1 | FPr | TTCAGGTTGTTGCAGGAGAC | SEQ ID NO: 280 |
| | | Probe | TGTCTCCATTATTGATCGGTTCATGCA | SEQ ID NO: 281 |
| | | RPr | CATCTTCTTGGGCACACAAT | SEQ ID NO: 282 |
| CCNB2 | NM_004701.2 | FPr | AGGCTTCTGCAGGAGACTCTGT | SEQ ID NO: 283 |
| | | Probe | TCGATCCATAATGCCAACGCACATG | SEQ ID NO: 284 |
| | | RPr | GGGAAACTGGCTGAACCTGTAA | SEQ ID NO: 285 |
| CCND1 | NM_001758.1 | FPr | GCATGTTCGTGGCCTCTAAGA | SEQ ID NO: 286 |
| | | Probe | AAGGAGACCATCCCCCTGACGGC | SEQ ID NO: 287 |
| | | RPr | CGGTGTAGATGCACAGCTTCTC | SEQ ID NO: 288 |

TABLE A-continued

| Gene | Accession | Reagt | Sequence | SEQ ID NO |
|---|---|---|---|---|
| CCND3 | NM_001760.2 | FPr | CCTCTGTGCTACAGATTATACCTTTGC | SEQ ID NO: 289 |
| | | Probe | TACCCGCCATCCATGATCGCCA | SEQ ID NO: 290 |
| | | RPr | CACTGCAGCCCCAATGCT | SEQ ID NO: 291 |
| CCNE1 | NM_001238.1 | FPr | AAAGAAGATGATGACCGGGTTTAC | SEQ ID NO: 292 |
| | | Probe | CAAACTCAACGTGCAAGCCTCGGA | SEQ ID NO: 293 |
| | | RPr | GAGCCTCTGGATGGTGCAAT | SEQ ID NO: 294 |
| CCNE2 | NM_057749.1 | FPr | GGTCACCAAGAAACATCAGTATGAA | SEQ ID NO: 295 |
| | | Probe | CCCAGATAATACAGGTGGCCAACAATTCCT | SEQ ID NO: 296 |
| | | RPr | TTCAATGATAATGCAAGGACTGATC | SEQ ID NO: 297 |
| CCNE2 variant 1 | NM_057749var1 | FPr | ATGCTGTGGCTCCTTCCTAACT | SEQ ID NO: 298 |
| | | Probe | TACCAAGCAACCTACATGTCAAGAAAGCCC | SEQ ID NO: 299 |
| | | RPr | ACCCAAATTGTGATATACAAAAAGGTT | SEQ ID NO: 300 |
| CCR7 | NM_001838.2 | FPr | GGATGACATGCACTCAGCTC | SEQ ID NO: 301 |
| | | Probe | CTCCCATCCCAGTGGAGCCAA | SEQ ID NO: 302 |
| | | RPr | CCTGACATTTCCCTTGTCCT | SEQ ID NO: 303 |
| CD105 | NM_000118.1 | FPr | GCAGGTGTCAGCAAGTATGATCAG | SEQ ID NO: 304 |
| | | Probe | CGACAGGATATTGACCACCGCCTCATT | SEQ ID NO: 305 |
| | | RPr | TTTTTCCGCTGTGGTGATGA | SEQ ID NO: 306 |
| CD134 (TNFRSF4 official) | NM_003327.1 | FPr | GCCCAGTGCGGAGAACAG | SEQ ID NO: 307 |
| | | Probe | CCAGCTTGATTCTCGTCTCTGCACTTAAGC | SEQ ID NO: 308 |
| | | RPr | AATCACACGCACCTGGAGAAC | SEQ ID NO: 309 |
| CD18 | NM_000211.1 | FPr | CGTCAGGACCCACCATGTCT | SEQ ID NO: 310 |
| | | Probe | CGCGGCCGAGACATGGCTTG | SEQ ID NO: 311 |
| | | RPr | GGTTAATTGGTGACATCCTCAAGA | SEQ ID NO: 312 |
| CD24 | NM_013230.1 | FPr | TCCAACTAATGCCACCACCAA | SEQ ID NO: 313 |
| | | Probe | CTGTTGACTGCAGGGCACCACCA | SEQ ID NO: 314 |
| | | RPr | GAGAGAGTGAGACCACGAAGAGACT | SEQ ID NO: 315 |
| CD28 | NM_006139.1 | FPr | TGTGAAAGGGAAACACCTTTG | SEQ ID NO: 316 |
| | | Probe | CCAAGTCCCCTATTTCCCGGACCT | SEQ ID NO: 317 |
| | | RPr | AGCACCCAAAAGGGCTTAG | SEQ ID NO: 318 |
| CD31 | NM_000442.1 | FPr | TGTATTTCAAGACCTCTGTGCACTT | SEQ ID NO: 319 |
| | | Probe | TTTATGAACCTGCCCTGCTCCCACA | SEQ ID NO: 320 |
| | | RPr | TTAGCCTGAGGAATTGCTGTGTT | SEQ ID NO: 321 |
| CD34 | NM_001773.1 | FPr | CCACTGCACACACCTCAGA | SEQ ID NO: 322 |
| | | Probe | CTGTTCTTGGGGCCCTACACCTTG | SEQ ID NO: 323 |
| | | RPr | CAGGAGTTTACCTGCCCCT | SEQ ID NO: 324 |
| CD3z | NM_000734.1 | FPr | AGATGAAGTGGAAGGCGCTT | SEQ ID NO: 325 |
| | | Probe | CACCGCGGCCATCCTGCA | SEQ ID NO: 326 |
| | | RPr | TGCCTCTGTAATCGGCAACTG | SEQ ID NO: 327 |
| CD44E | X55150 | FPr | ATCACCGACAGCACAGACA | SEQ ID NO: 328 |
| | | Probe | CCCTGCTACCAATATGGACTCCAGTCA | SEQ ID NO: 329 |
| | | RPr | ACCTGTGTTTGGATTTGCAG | SEQ ID NO: 330 |
| CD44s | M59040.1 | FPr | GACGAAGACAGTCCCTGGAT | SEQ ID NO: 331 |
| | | Probe | CACCGACAGCACAGACAGAATCCC | SEQ ID NO: 332 |
| | | RPr | ACTGGGGTGGAATGTGTCTT | SEQ ID NO: 333 |
| CD44v3 | AJ251595v3 | FPr | CACACAAAACAGAACCAGGACT | SEQ ID NO: 334 |
| | | Probe | ACCCAGTGGAACCCAAGCCATTC | SEQ ID NO: 335 |
| | | RPr | CTGAAGTAGCACTTCCGGATT | SEQ ID NO: 336 |
| CD44v6 | AJ251595v6 | FPr | CTCATACCAGCCATCCAATG | SEQ ID NO: 337 |
| | | Probe | CACCAAGCCCAGAGGACAGTTCCT | SEQ ID NO: 338 |
| | | RPr | TTGGGTTGAAGAAATCAGTCC | SEQ ID NO: 339 |
| CD68 | NM_001251.1 | FPr | TGGTTCCCAGCCCTGTGT | SEQ ID NO: 340 |
| | | Probe | CTCCAAGCCCAGATTCAGATTCGAGTCA | SEQ ID NO: 341 |
| | | RPr | CTCCTCCACCCTGGGTTGT | SEQ ID NO: 342 |

TABLE A-continued

| Gene | Accession | Reagt | Sequence | SEQ ID NO |
|---|---|---|---|---|
| CD80 | NM_005191.2 | FPr | TTCAGTTGCTTTGCAGGAAG | SEQ ID NO: 343 |
| | | Probe | TTCTGTGCCCACCATATTCCTCTAGACA | SEQ ID NO: 344 |
| | | RPr | TTGATCAAGGTCACCAGAGC | SEQ ID NO: 345 |
| CD82 | NM_002231.2 | FPr | GTGCAGGCTCAGGTGAAGTG | SEQ ID NO: 346 |
| | | Probe | TCAGCTTCTACAACTGGACAGACAACGCTG | SEQ ID NO: 347 |
| | | RPr | GACCTCAGGGCGATTCATGA | SEQ ID NO: 348 |
| CD8A | NM_171827.1 | FPr | AGGGTGAGGTGCTTGAGTCT | SEQ ID NO: 349 |
| | | Probe | CCAACGGCAAGGGAACAAGTACTTCT | SEQ ID NO: 350 |
| | | RPr | GGGCACAGTATCCCAGGTA | SEQ ID NO: 351 |
| CD9 | NM_001769.1 | FPr | GGGCGTGGAACAGTTTATCT | SEQ ID NO: 352 |
| | | Probe | AGACATCTGCCCCAAGAAGGACGT | SEQ ID NO: 353 |
| | | RPr | CACGGTGAAGGTTTCGAGT | SEQ ID NO: 354 |
| CDC2 | NM_001786.2 | FPr | GAGAGCGACGCGGTTGTT | SEQ ID NO: 355 |
| | | Probe | TAGCTGCCGCTGCGGCCG | SEQ ID NO: 356 |
| | | RPr | GTATGGTAGATCCCGGCTTATTATTC | SEQ ID NO: 357 |
| CDC20 | NM_001255.1 | FPr | TGGATTGGAGTTCTGGGAATG | SEQ ID NO: 358 |
| | | Probe | ACTGGCCGTGGCACTGGACACA | SEQ ID NO: 359 |
| | | RPr | GCTTGCACTCCACAGGTACACA | SEQ ID NO: 360 |
| cdc25A | NM_001789.1 | FPr | TCTTGCTGGCTACGCCTCTT | SEQ ID NO: 361 |
| | | Probe | TGTCCCTGTTAGACGTCCTCCGTCCATA | SEQ ID NO: 362 |
| | | RPr | CTGCATTGTGGCACAGTTCTG | SEQ ID NO: 363 |
| CDC25B | NM_021874.1 | FPr | AAACGAGCAGTTTGCCATCAG | SEQ ID NO: 364 |
| | | Probe | CCTCACCGGCATAGACTGGAAGCG | SEQ ID NO: 365 |
| | | RPr | GTTGGTGATGTTCCGAAGCA | SEQ ID NO: 366 |
| CDC25C | NM_001790.2 | FPr | GGTGAGCAGAAGTGGCCTAT | SEQ ID NO: 367 |
| | | Probe | CTCCCCGTCGATGCCAGAGAACT | SEQ ID NO: 368 |
| | | RPr | CTTCAGTCTTGGCCTGTTCA | SEQ ID NO: 369 |
| CDC4 | NM_018315.2 | FPr | GCAGTCCGCTGTGTTCAA | SEQ ID NO: 370 |
| | | Probe | TGCTCCACTAACAACCCTCCTGCC | SEQ ID NO: 371 |
| | | RPr | GGATCCCACACCTTTACCATAA | SEQ ID NO: 372 |
| CDC42 | NM_001791.2 | FPr | TCCAGAGACTGCTGAAAA | SEQ ID NO: 373 |
| | | Probe | CCCGTGACCTGAAGGCTGTCAAG | SEQ ID NO: 374 |
| | | RPr | TGTGTAAGTGCAGAACAC | SEQ ID NO: 375 |
| CDC42BPA | NM_003607.2 | FPr | GAGCTGAAAGACGCACACTG | SEQ ID NO: 376 |
| | | Probe | AATTCCTGCATGGCCAGTTTCCTC | SEQ ID NO: 377 |
| | | RPr | GCCGCTCATTGATCTCCA | SEQ ID NO: 378 |
| CDC6 | NM_001254.2 | FPr | GCAACACTCCCCATTTACCTC | SEQ ID NO: 379 |
| | | Probe | TTGTTCTCCACCAAAGCAAGGCAA | SEQ ID NO: 380 |
| | | RPr | TGAGGGGGACCATTCTCTTT | SEQ ID NO: 381 |
| CDCA7 v2 | NM_145810.1 | FPr | AAGACCGTGGATGGCTACAT | SEQ ID NO: 382 |
| | | Probe | ATGAAGATGACCTGCCCAGAAGCC | SEQ ID NO: 383 |
| | | RPr | AGGGTCACGGATGATCTGG | SEQ ID NO: 384 |
| CDH1 | NM_004360.2 | FPr | TGAGTGTCCCCCGGTATCTTC | SEQ ID NO: 385 |
| | | Probe | TGCCAATCCCGATGAAATTGGAAATTT | SEQ ID NO: 386 |
| | | RPr | CAGCCGCTTTCAGATTTTCAT | SEQ ID NO: 387 |
| CDH11 | NM_001797.2 | FPr | GTCGGCAGAAGCAGGACT | SEQ ID NO: 388 |
| | | Probe | CCTTCTGCCCATAGTGATCAGCGA | SEQ ID NO: 389 |
| | | RPr | CTACTCATGGGCGGGATG | SEQ ID NO: 390 |
| CDH3 | NM_001793.3 | FPr | ACCCATGTACCGTCCTCG | SEQ ID NO: 391 |
| | | Probe | CCAACCCAGATGAAATCGGCAACT | SEQ ID NO: 392 |
| | | RPr | CCGCCTTCAGGTTCTCAAT | SEQ ID NO: 393 |
| CDK2 | NM_001798.2 | FPr | AATGCTGCACTACGACCCTA | SEQ ID NO: 394 |
| | | Probe | CCTTGGCCGAAATCCGCTTGT | SEQ ID NO: 395 |
| | | RPr | TTGGTCACATCCTGGAAGAA | SEQ ID NO: 396 |
| CDX1 | NM_001804.1 | FPr | AGCAACACCAGCCTCCTG | SEQ ID NO: 397 |
| | | Probe | CACCTCCTCTCCAATGCCTGTGAA | SEQ ID NO: 398 |
| | | RPr | GGGCTATGGCAGAAACTCCT | SEQ ID NO: 399 |

TABLE A-continued

| Gene | Accession | Reagt | Sequence | SEQ ID NO |
|---|---|---|---|---|
| Cdx2 | NM_001265.2 | FPr | GGGCAGGCAAGGTTTACA | SEQ ID NO: 400 |
| | | Probe | ATCTTAGCTGCCTTTGGCTTCCGC | SEQ ID NO: 401 |
| | | RPr | GTCTTTGGTCAGTCCAGCTTTC | SEQ ID NO: 402 |
| CEACAM1 | NM_001712.2 | FPr | ACTTGCCTGTTCAGAGCACTCA | SEQ ID NO: 403 |
| | | Probe | TCCTTCCCACCCCAGTCCTGTC | SEQ ID NO: 404 |
| | | RPr | TGGCAAATCCGAATTAGAGTGA | SEQ ID NO: 405 |
| CEACAM6 | NM_002483.2 | FPr | CACAGCCTCACTTCTAACCTTCTG | SEQ ID NO: 406 |
| | | Probe | ACCCACCCACCACTGCCAAGCTC | SEQ ID NO: 407 |
| | | RPr | TTGAATGGCGTGGATTCAATAG | SEQ ID NO: 408 |
| CEBPB | NM_005194.2 | FPr | GCAACCCACGTGTAACTGTC | SEQ ID NO: 409 |
| | | Probe | CCGGGCCCTGAGTAATCGCTTAA | SEQ ID NO: 410 |
| | | RPr | ACAAGCCCGTAGGAACATCT | SEQ ID NO: 411 |
| CEGP1 | NM_020974.1 | FPr | TGACAATCAGCACACCTGCAT | SEQ ID NO: 412 |
| | | Probe | CAGGCCCTCTTCCGAGCGGT | SEQ ID NO: 413 |
| | | RPr | TGTGACTACAGCCGTGATCCTTA | SEQ ID NO: 414 |
| CENPA | NM_001809.2 | FPr | TAAATTCACTCGTGGTGTGGA | SEQ ID NO: 415 |
| | | Probe | CTTCAATTGGCAAGCCCAGGC | SEQ ID NO: 416 |
| | | RPr | GCCTCTTGTAGGGCCAATAG | SEQ ID NO: 417 |
| CENPE | NM_001813.1 | FPr | GGATGCTGGTGACCTCTTCT | SEQ ID NO: 418 |
| | | Probe | TCCCTCACGTTGCAACAGGAATTAA | SEQ ID NO: 419 |
| | | RPr | GCCAAGGCACCAAGTAACTC | SEQ ID NO: 420 |
| CENPF | NM_016343.2 | FPr | CTCCCGTCAACAGCGTTC | SEQ ID NO: 421 |
| | | Probe | ACACTGGACCAGGAGTGCATCCAG | SEQ ID NO: 422 |
| | | RPr | GGGTGAGTCTGGCCTTCA | SEQ ID NO: 423 |
| CES2 | NM_003869.4 | FPr | ACTTTGCGAGAAATGGGAAC | SEQ ID NO: 424 |
| | | Probe | AGTGTGGCAGACCCTCGCCATT | SEQ ID NO: 425 |
| | | RPr | CAGGTATTGCTCCTCCTGGT | SEQ ID NO: 426 |
| CGA (CHGA official) | NM_001275.2 | FPr | CTGAAGGAGCTCCAAGACCT | SEQ ID NO: 427 |
| | | Probe | TGCTGATGTGCCCTCTCCTTGG | SEQ ID NO: 428 |
| | | RPr | CAAAACCGCTGTGTTTCTTC | SEQ ID NO: 429 |
| CGB | NM_000737.2 | FPr | CCACCATAGGCAGAGGCA | SEQ ID NO: 430 |
| | | Probe | ACACCCTACTCCCTGTGCCTCCAG | SEQ ID NO: 431 |
| | | RPr | AGTCGTCGAGTGCTAGGGAC | SEQ ID NO: 432 |
| CHAF1B | NM_005441.1 | FPr | GAGGCCAGTGGTGGAAACAG | SEQ ID NO: 433 |
| | | Probe | AGCTGATGAGTCTGCCCTACCGCCTG | SEQ ID NO: 434 |
| | | RPr | TCCGAGGCCACAGCAAAC | SEQ ID NO: 435 |
| CHD2 | NM_001271.1 | FPr | CTCTGTGCGAGGCTGTCA | SEQ ID NO: 436 |
| | | Probe | ACCCATCTCGGGATCCCTGATACC | SEQ ID NO: 437 |
| | | RPr | GGTAAGGACTGTGGGCTGG | SEQ ID NO: 438 |
| CHFR | NM_018223.1 | FPr | AAGGAAGTGGTCCCTCTGTG | SEQ ID NO: 439 |
| | | Probe | TGAAGTCTCCAGCTTTGCCTCAGC | SEQ ID NO: 440 |
| | | RPr | GACGCAGTCTTTCTGTCTGG | SEQ ID NO: 441 |
| Chk1 | NM_001274.1 | FPr | GATAAATTGGTACAAGGGATCAGCTT | SEQ ID NO: 442 |
| | | Probe | CCAGCCCACATGTCCTGATCATATGC | SEQ ID NO: 443 |
| | | RPr | GGGTGCCAAGTAACTGACTATTCA | SEQ ID NO: 444 |
| Chk2 | NM_007194.1 | FPr | ATGTGGAACCCCCACCTACTT | SEQ ID NO: 445 |
| | | Probe | AGTCCCAACAGAAACAAGAACTTCAGGCG | SEQ ID NO: 446 |
| | | RPr | CAGTCCACAGCACGGTTATACC | SEQ ID NO: 447 |
| CIAP1 | NM_001166.2 | FPr | TGCCTGTGGTGGGAAGCT | SEQ ID NO: 448 |
| | | Probe | TGACATAGCATCATCCTTTGGTTCCCAGTT | SEQ ID NO: 449 |
| | | RPr | GGAAAATGCCTCCGGTGTT | SEQ ID NO: 450 |
| cIAP2 | NM_001165.2 | FPr | GGATATTTCCGTGGCTCTTATTCA | SEQ ID NO: 451 |
| | | Probe | TCTCCATCAAATCCTGTAAACTCCAGAGCA | SEQ ID NO: 452 |
| | | RPr | CTTCTCATCAAGGCAGAAAAATCTT | SEQ ID NO: 453 |
| CKS1B | NM_001826.1 | FPr | GGTCCCTAAAACCCATCTGA | SEQ ID NO: 454 |
| | | Probe | TGAACGCCAAGATTCCTCCATTCA | SEQ ID NO: 455 |
| | | RPr | TAATGGACCCATCCCTGACT | SEQ ID NO: 456 |

TABLE A-continued

| Gene | Accession | Reagt | Sequence | SEQ ID NO |
|---|---|---|---|---|
| CKS2 | NM_001827.1 | FPr | GGCTGGACGTGGTTTTGTCT | SEQ ID NO: 457 |
| | | Probe | CTGCGCCCGCTCTTCGCG | SEQ ID NO: 458 |
| | | RPr | CGCTGCAGAAAATGAAACGA | SEQ ID NO: 459 |
| Claudin 4 | NM_001305.2 | FPr | GGCTGCTTTGCTGCAACTG | SEQ ID NO: 460 |
| | | Probe | CGCACAGACAAGCCTTACTCCGCC | SEQ ID NO: 461 |
| | | RPr | CAGAGCGGGCAGCAGAATA | SEQ ID NO: 462 |
| CLDN1 | NM_021101.3 | FPr | TCTGGGAGGTGCCCTACTT | SEQ ID NO: 463 |
| | | Probe | TGTTCCTGTCCCCGAAAAACAACC | SEQ ID NO: 464 |
| | | RPr | TGGATAGGGCCTTGGTGTT | SEQ ID NO: 465 |
| CLDN7 | NM_001307.3 | FPr | GGTCTGCCCTAGTCATCCTG | SEQ ID NO: 466 |
| | | Probe | TGCACTGCTCTCCTGTTCCTGTCC | SEQ ID NO: 467 |
| | | RPr | GTACCCAGCCTTGCTCTCAT | SEQ ID NO: 468 |
| CLIC1 | NM_001288.3 | FPr | CGGTACTTGAGCAATGCCTA | SEQ ID NO: 469 |
| | | Probe | CGGGAAGAATTCGCTTCCACCTG | SEQ ID NO: 470 |
| | | RPr | TCGATCTCCTCATCATCTGG | SEQ ID NO: 471 |
| CLTC | NM_004859.1 | FPr | ACCGTATGGACAGCCACAG | SEQ ID NO: 472 |
| | | Probe | TCTCACATGCTGTACCCAAAGCCA | SEQ ID NO: 473 |
| | | RPr | TGACTACAGGATCAGCGCTTC | SEQ ID NO: 474 |
| CLU | NM_001831.1 | FPr | CCCCAGGATACCTACCACTACCT | SEQ ID NO: 475 |
| | | Probe | CCCTTCAGCCTGCCCCACCG | SEQ ID NO: 476 |
| | | RPr | TGCGGGACTTGGGAAAGA | SEQ ID NO: 477 |
| cMet | NM_000245.1 | FPr | GACATTTCCAGTCCTGCAGTCA | SEQ ID NO: 478 |
| | | Probe | TGCCTCTCTGCCCCACCCTTTGT | SEQ ID NO: 479 |
| | | RPr | CTCCGATCGCACACATTTGT | SEQ ID NO: 480 |
| cMYC | NM_002467.1 | FPr | TCCCTCCACTCGGAAGGACTA | SEQ ID NO: 481 |
| | | Probe | TCTGACACTGTCCAACTTGACCCTCTT | SEQ ID NO: 482 |
| | | RPr | CGGTTGTTGCTGATCTGTCTCA | SEQ ID NO: 483 |
| CNN | NM_001299.2 | FPr | TCCACCCTCCTGGCTTTG | SEQ ID NO: 484 |
| | | Probe | TCCTTTCGTCTTCGCCATGCTGG | SEQ ID NO: 485 |
| | | RPr | TCACTCCCACGTTCACCTTGT | SEQ ID NO: 486 |
| COL1A1 | NM_000088.2 | FPr | GTGGCCATCCAGCTGACC | SEQ ID NO: 487 |
| | | Probe | TCCTGCGCCTGATGTCCACCG | SEQ ID NO: 488 |
| | | RPr | CAGTGGTAGGTGATGTTCTGGGA | SEQ ID NO: 489 |
| COL1A2 | NM_000089.2 | FPr | CAGCCAAGAACTGGTATAGGAGCT | SEQ ID NO: 490 |
| | | Probe | TCTCCTAGCCAGACGTGTTTCTTGTCCTTG | SEQ ID NO: 491 |
| | | RPr | AAACTGGCTGCCAGCATTG | SEQ ID NO: 492 |
| COPS3 | NM_003653.2 | FPr | ATGCCCAGTGTTCCTGACTT | SEQ ID NO: 493 |
| | | Probe | CGAAACGCTATTCTCACAGGTTCAGC | SEQ ID NO: 494 |
| | | RPr | CTCCCCATTACAAGTGCTGA | SEQ ID NO: 495 |
| COX2 | NM_000963.1 | FPr | TCTGCAGAGTTGGAAGCACTCTA | SEQ ID NO: 496 |
| | | Probe | CAGGATACAGCTCCACAGCATCGATGTC | SEQ ID NO: 497 |
| | | RPr | GCCGAGGCTTTTCTACCAGAA | SEQ ID NO: 498 |
| COX3 | MITO_COX3 | FPr | TCGAGTCTCCCTTCACCATT | SEQ ID NO: 499 |
| | | Probe | CGACGGCATCTACGGCTCAACAT | SEQ ID NO: 500 |
| | | RPr | GACGTGAAGTCCGTGGAAG | SEQ ID NO: 501 |
| CP | NM_000096.1 | FPr | CGTGAGTACACAGATGCCTCC | SEQ ID NO: 502 |
| | | Probe | TCTTCAGGGCCTCTCTCCTTTCGA | SEQ ID NO: 503 |
| | | RPr | CCAGGATGCCAAGATGCT | SEQ ID NO: 504 |
| CRBP | NM_002899.2 | FPr | TGGTCTGCAAGCAAGTATTCAAG | SEQ ID NO: 505 |
| | | Probe | TCTGCTTGGGCCTCACTGACCT | SEQ ID NO: 506 |
| | | RPr | GCTGATTGGTTGGGACAAGGT | SEQ ID NO: 507 |
| CREBBP | NM_004380.1 | FPr | TGGGAAGCAGCTGTGTACCAT | SEQ ID NO: 508 |
| | | Probe | CCTCGCGATGCTGCCTACTACAGCTATC | SEQ ID NO: 509 |
| | | RPr | GAAACACTTCTCACAGAAATGATACCTATT | SEQ ID NO: 510 |
| CRIP2 | NM_001312.1 | FPr | GTGCTACGCCACCCTGTT | SEQ ID NO: 511 |
| | | Probe | CCGATGTTCACGCCTTTGGGTC | SEQ ID NO: 512 |
| | | RPr | CAGGGGCTTCTCGTAGATGT | SEQ ID NO: 513 |

TABLE A-continued

| Gene | Accession | Reagt | Sequence | SEQ ID NO |
|---|---|---|---|---|
| cripto (TDGF1 official) | NM_003212.1 | FPr | GGGTCTGTGCCCCATGAC | SEQ ID NO: 514 |
| | | Probe | CCTGGCTGCCCAAGAAGTGTTCCCT | SEQ ID NO: 515 |
| | | RPr | TGACCGTGCCAGCATTTACA | SEQ ID NO: 516 |
| CRK(a) | NM_016823.2 | FPr | CTCCCTAACCTCCAGAATGG | SEQ ID NO: 517 |
| | | Probe | ACTCGCTTCTGGATAACCCTGGCA | SEQ ID NO: 518 |
| | | RPr | TGTCTTGTCGTAGGCATTGG | SEQ ID NO: 519 |
| CRMP1 | NM_001313.1 | FPr | AAGGTTTTTGGATTGCAAGG | SEQ ID NO: 520 |
| | | Probe | ACCGTCATACATGCCCCTGGAAAC | SEQ ID NO: 521 |
| | | RPr | GGGTGTAGCTGGTACCTCGT | SEQ ID NO: 522 |
| CRYAB | NM_001885.1 | FPr | GATGTGATTGAGGTGCATGG | SEQ ID NO: 523 |
| | | Probe | TGTTCATCCTGGCGCTCTTCATGT | SEQ ID NO: 524 |
| | | RPr | GAACTCCCTGGAGATGAAACC | SEQ ID NO: 525 |
| CSEL1 | NM_001316.2 | FPr | TTACGCAGCTCATGCTCTTG | SEQ ID NO: 526 |
| | | Probe | ACGGCTCTTTACTATGCGAGGGCC | SEQ ID NO: 527 |
| | | RPr | GCAGCTGTAAAGAGAGTGGCAT | SEQ ID NO: 528 |
| CSF1 | NM_000757.3 | FPr | TGCAGCGGCTGATTGACA | SEQ ID NO: 529 |
| | | Probe | TCAGATGGAGACCTCGTGCCAAATTACA | SEQ ID NO: 530 |
| | | RPr | CAACTGTTCCTGGTCTACAAACTCA | SEQ ID NO: 531 |
| CSK (SRC) | NM_004383.1 | FPr | CCTGAACATGAAGGAGCTGA | SEQ ID NO: 532 |
| | | Probe | TCCCGATGGTCTGCAGCAGCT | SEQ ID NO: 533 |
| | | RPr | CATCACGTCTCCGAACTCC | SEQ ID NO: 534 |
| CTAG1B | NM_001327.1 | FPr | GCTCTCCATCAGCTCCTGTC | SEQ ID NO: 535 |
| | | Probe | CCACATCAACAGGGAAAGCTGCTG | SEQ ID NO: 536 |
| | | RPr | AACACGGGCAGAAAGCACT | SEQ ID NO: 537 |
| CTGF | NM_001901.1 | FPr | GAGTTCAAGTGCCCTGACG | SEQ ID NO: 538 |
| | | Probe | AACATCATGTTCTTCTTCATGACCTCGC | SEQ ID NO: 539 |
| | | RPr | AGTTGTAATGGCAGGCACAG | SEQ ID NO: 540 |
| CTHRC1 | NM_138455.2 | FPr | GCTCACTTCGGCTAAAATGC | SEQ ID NO: 541 |
| | | Probe | ACCAACGCTGACAGCATGCATTTC | SEQ ID NO: 542 |
| | | RPr | TCAGCTCCATTGAATGTGAAA | SEQ ID NO: 543 |
| CTLA4 | NM_005214.2 | FPr | CACTGAGGTCCGGGTGACA | SEQ ID NO: 544 |
| | | Probe | CACCTGGCTGTCAGCCTGCCG | SEQ ID NO: 545 |
| | | RPr | GTAGGTTGCCGCACAGACTTC | SEQ ID NO: 546 |
| CTNNBIP1 | NM_020248.2 | FPr | GTTTTCCAGGTCGGAGACG | SEQ ID NO: 547 |
| | | Probe | CTTTGCAGCTACTGCCTCCGGTCT | SEQ ID NO: 548 |
| | | RPr | AGCATCCAGGGTGTTCCA | SEQ ID NO: 549 |
| CTSB | NM_001908.1 | FPr | GGCCGAGATCTACAAAAACG | SEQ ID NO: 550 |
| | | Probe | CCCCGTGGAGGGAGCTTTCTC | SEQ ID NO: 551 |
| | | RPr | GCAGGAAGTCCGAATACACA | SEQ ID NO: 552 |
| CTSD | NM_001909.1 | FPr | GTACATGATCCCCTGTGAGAAGGT | SEQ ID NO: 553 |
| | | Probe | ACCCTGCCCGCGATCACACTGA | SEQ ID NO: 554 |
| | | RPr | GGGACAGCTTGTAGCCTTTGC | SEQ ID NO: 555 |
| CTSH | NM_004390.1 | FPr | GCAAGTTCCAACCTGGAAAG | SEQ ID NO: 556 |
| | | Probe | TGGCTACATCCTTGACAAAGCCGA | SEQ ID NO: 557 |
| | | RPr | CATCGCTTCCTCGTCATAGA | SEQ ID NO: 558 |
| CTSL | NM_001912.1 | FPr | GGGAGGCTTATCTCACTGAGTGA | SEQ ID NO: 559 |
| | | Probe | TTGAGGCCCAGAGCAGTCTACCAGATTCT | SEQ ID NO: 560 |
| | | RPr | CCATTGCAGCCTTCATTGC | SEQ ID NO: 561 |
| CTSL2 | NM_001333.2 | FPr | TGTCTCACTGAGCGAGCAGAA | SEQ ID NO: 562 |
| | | Probe | CTTGAGGACGCGAACAGTCCACCA | SEQ ID NO: 563 |
| | | RPr | ACCATTGCAGCCCTGATTG | SEQ ID NO: 564 |
| CUL1 | NM_003592.2 | FPr | ATGCCCTGGTAATGTCTGCAT | SEQ ID NO: 565 |
| | | Probe | CAGCCACAAAGCCAGCGTCATTGT | SEQ ID NO: 566 |
| | | RPr | GCGACCACAAGCCTTATCAAG | SEQ ID NO: 567 |
| CUL4A | NM_003589.1 | FPr | AAGCATCTTCCTGTTCTTGGA | SEQ ID NO: 568 |
| | | Probe | TATGTGCTGCAGAACTCCACGCTG | SEQ ID NO: 569 |
| | | RPr | AATCCCATATCCCAGATGGA | SEQ ID NO: 570 |

TABLE A-continued

| Gene | Accession | Reagt | Sequence | SEQ ID NO |
|---|---|---|---|---|
| CXCL12 | NM_000609.3 | FPr | GAGCTACAGATGCCCATGC | SEQ ID NO: 571 |
| | | Probe | TTCTTCGAAAGCCATGTTGCCAGA | SEQ ID NO: 572 |
| | | RPr | TTTGAGATGCTTGACGTTGG | SEQ ID NO: 573 |
| CXCR4 | NM_003467.1 | FPr | TGACCGCTTCTACCCCAATG | SEQ ID NO: 574 |
| | | Probe | CTGAAACTGGAACACAACCACCCACAAG | SEQ ID NO: 575 |
| | | RPr | AGGATAAGGCCAACCATGATGT | SEQ ID NO: 576 |
| CYBA | NM_000101.1 | FPr | GGTGCCTACTCCATTGTGG | SEQ ID NO: 577 |
| | | Probe | TACTCCAGCAGGCACACAAACACG | SEQ ID NO: 578 |
| | | RPr | GTGGAGCCCTTCTTCCTCTT | SEQ ID NO: 579 |
| CYP1B1 | NM_000104.2 | FPr | CCAGCTTTGTGCCTGTCACTAT | SEQ ID NO: 580 |
| | | Probe | CTCATGCCACCACTGCCAACACCTC | SEQ ID NO: 581 |
| | | RPr | GGGAATGTGGTAGCCCAAGA | SEQ ID NO: 582 |
| CYP2C8 | NM_000770.2 | FPr | CCGTGTTCAAGAGGAAGCTC | SEQ ID NO: 583 |
| | | Probe | TTTTCTCAACTCCTCCACAAGGCA | SEQ ID NO: 584 |
| | | RPr | AGTGGGATCACAGGGTGAAG | SEQ ID NO: 585 |
| CYP3A4 | NM_017460.3 | FPr | AGAACAAGGACAACATAGATCCTTACATAT | SEQ ID NO: 586 |
| | | Probe | CACACCCTTTGGAAGTGGACCCAGAA | SEQ ID NO: 587 |
| | | RPr | GCAAACCTCATGCCAATGC | SEQ ID NO: 588 |
| CYR61 | NM_001554.3 | FPr | TGCTCATTCTTGAGGAGCAT | SEQ ID NO: 589 |
| | | Probe | CAGCACCCTTGGCAGTTTCGAAAT | SEQ ID NO: 590 |
| | | RPr | GTGGCTGCATTAGTGTCCAT | SEQ ID NO: 591 |
| DAPK1 | NM_004938.1 | FPr | CGCTGACATCATGAATGTTCCT | SEQ ID NO: 592 |
| | | Probe | TCATATCCAAACTCGCCTCCAGCCG | SEQ ID NO: 593 |
| | | RPr | TCTCTTTCAGCAACGATGTGTCTT | SEQ ID NO: 594 |
| DCC | NM_005215.1 | FPr | AAATGTCCTCCTCGACTGCT | SEQ ID NO: 595 |
| | | Probe | ATCACTGGAACTCCTCGGTCGGAC | SEQ ID NO: 596 |
| | | RPr | TGAATGCCATCTTTCTTCCA | SEQ ID NO: 597 |
| DCC_exons 18-23 | X76132_18-23 | FPr | GGTCACCGTTGGTGTCATCA | SEQ ID NO: 598 |
| | | Probe | CAGCCACGATGACCACTACCAGCACT | SEQ ID NO: 599 |
| | | RPr | GAGCGTCGGGTGCAAATC | SEQ ID NO: 600 |
| DCC_exons 6-7 | X76132_6-7 | FPr | ATGGAGATGTGGTCATTCCTAGTG | SEQ ID NO: 601 |
| | | Probe | TGCTTCCTCCCACTATCTGAAAATAA | SEQ ID NO: 602 |
| | | RPr | CACCACCCCAAGTATCCGTAAG | SEQ ID NO: 603 |
| DCK | NM_000788.1 | FPr | GCCGCCACAAGACTAAGGAAT | SEQ ID NO: 604 |
| | | Probe | AGCTGCCCGTCTTTCTCAGCCAGC | SEQ ID NO: 605 |
| | | RPr | CGATGTTCCCTTCGATGGAG | SEQ ID NO: 606 |
| DDB1 | NM_001923.2 | FPr | TGCGGATCATCCGGAATG | SEQ ID NO: 607 |
| | | Probe | AATTGGAATCCACGAGCATGCCAGC | SEQ ID NO: 608 |
| | | RPr | TCCTTTGATGCCTGGTAAGTCA | SEQ ID NO: 609 |
| DET1 | NM_017996.2 | FPr | CTTGTGGAGATCACCCAATCAG | SEQ ID NO: 610 |
| | | Probe | CTATGCCCGGGACTCGGGCCT | SEQ ID NO: 611 |
| | | RPr | CCCGCCTGGATCTCAAACT | SEQ ID NO: 612 |
| DHFR | NM_000791.2 | FPr | TTGCTATAACTAAGTGCTTCTCCAAGA | SEQ ID NO: 613 |
| | | Probe | CCCAACTGAGTCCCCAGCACCT | SEQ ID NO: 614 |
| | | RPr | GTGGAATGGCAGCTCACTGTAG | SEQ ID NO: 615 |
| DHPS | NM_013407.1 | FPr | GGGAGAACGGGATCAATAGGAT | SEQ ID NO: 616 |
| | | Probe | CTCATTGGGCACCAGCAGGTTTCC | SEQ ID NO: 617 |
| | | RPr | GCATCAGCCAGTCCTCAAACT | SEQ ID NO: 618 |
| DIABLO | NM_019887.1 | FPr | CACAATGGCGGCTCTGAAG | SEQ ID NO: 619 |
| | | Probe | AAGTTACGCTGCGCGACAGCCAA | SEQ ID NO: 620 |
| | | RPr | ACACAAACACTGTCTGTACCTGAAGA | SEQ ID NO: 621 |
| DIAPH1 | NM_005219.2 | FPr | CAAGCAGTCAAGGAGAACCA | SEQ ID NO: 622 |
| | | Probe | TTCTTCTGTCTCCCGCCGCTTC | SEQ ID NO: 623 |
| | | RPr | AGTTTTGCTCGCCTCATCTT | SEQ ID NO: 624 |
| DICER1 | NM_177438.1 | FPr | TCCAATTCCAGCATCACTGT | SEQ ID NO: 625 |
| | | Probe | AGAAAAGCTGTTTGTCTCCCCAGCA | SEQ ID NO: 626 |
| | | RPr | GGCAGTGAAGGCGATAAAGT | SEQ ID NO: 627 |

TABLE A-continued

| Gene | Accession | Reagt | Sequence | SEQ ID NO |
|---|---|---|---|---|
| DKK1 | NM_012242.1 | FPr | TGACAACTACCAGCCGTACC | SEQ ID NO: 628 |
| | | Probe | AGTGCCGCACTCCTCGTCCTCT | SEQ ID NO: 629 |
| | | RPr | GGGACTAGCGCAGTACTCATC | SEQ ID NO: 630 |
| DLC1 | NM_006094.3 | FPr | GATTCAGACGAGGATGAGCC | SEQ ID NO: 631 |
| | | Probe | AAAGTCCATTTGCCACTGATGGCA | SEQ ID NO: 632 |
| | | RPr | CACCTCTTGCTGTCCCTTTG | SEQ ID NO: 633 |
| DPYD | NM_000110.2 | FPr | AGGACGCAAGGAGGGTTTG | SEQ ID NO: 634 |
| | | Probe | CAGTGCCTACAGTCTCGAGTCTGCCAGTG | SEQ ID NO: 635 |
| | | RPr | GATGTCCGCCGAGTCCTTACT | SEQ ID NO: 636 |
| DR4 | NM_003844.1 | FPr | TGCACAGAGGGTGTGGGTTAC | SEQ ID NO: 637 |
| | | Probe | CAATGCTTCCAACAATTTGTTTGCTTGCC | SEQ ID NO: 638 |
| | | RPr | TCTTCATCTGATTTACAAGCTGTACATG | SEQ ID NO: 639 |
| DR5 | NM_003842.2 | FPr | CTCTGAGACAGTGCTTCGATGACT | SEQ ID NO: 640 |
| | | Probe | CAGACTTGGTGCCCTTTGACTCC | SEQ ID NO: 641 |
| | | RPr | CCATGAGGCCCAACTTCCT | SEQ ID NO: 642 |
| DRG1 | NM_004147.3 | FPr | CCTGGATCTCCCAGGTATCA | SEQ ID NO: 643 |
| | | Probe | ACCTTTCCCATCCTTGGCACCTTC | SEQ ID NO: 644 |
| | | RPr | TGCAATGACTTGACGACCTC | SEQ ID NO: 645 |
| DSP | NM_004415.1 | FPr | TGGCACTACTGCATGATTGACA | SEQ ID NO: 646 |
| | | Probe | CAGGGCCATGACAATCGCCAA | SEQ ID NO: 647 |
| | | RPr | CCTGCCGCATTGTTTTCAG | SEQ ID NO: 648 |
| DTYMK | NM_012145.1 | FPr | AAATCGCTGGGAACAAGTG | SEQ ID NO: 649 |
| | | Probe | CGCCCTGGCTCAACTTTTCCTTAA | SEQ ID NO: 650 |
| | | RPr | AATGCGTATCTGTCCACGAC | SEQ ID NO: 651 |
| DUSP1 | NM_004417.2 | FPr | AGACATCAGCTCCTGGTTCA | SEQ ID NO: 652 |
| | | Probe | CGAGGCCATTGACTTCATAGACTCCA | SEQ ID NO: 653 |
| | | RPr | GACAAACACCCTTCCTCCAG | SEQ ID NO: 654 |
| DUSP2 | NM_004418.2 | FPr | TATCCCTGTGGAGGACAACC | SEQ ID NO: 655 |
| | | Probe | CCTCCTGGAACCAGGCACTGATCT | SEQ ID NO: 656 |
| | | RPr | CACCCAGTCAATGAAGCCTA | SEQ ID NO: 657 |
| DUT | NM_001948.2 | FPr | ACACATGGAGTGCTTCTGGA | SEQ ID NO: 658 |
| | | Probe | ATCAGCCCACTTGACCACCCAGTT | SEQ ID NO: 659 |
| | | RPr | CTCTTGCCTGTGCTTCCAC | SEQ ID NO: 660 |
| DYRK1B | NM_004714.1 | FPr | AGCATGACACGGAGATGAAG | SEQ ID NO: 661 |
| | | Probe | CACCTGAAGCGGCACTTCATGTTC | SEQ ID NO: 662 |
| | | RPr | AATACCAGGCACAGGTGGTT | SEQ ID NO: 663 |
| E2F1 | NM_005225.1 | FPr | ACTCCCTCTACCCTTGAGCA | SEQ ID NO: 664 |
| | | Probe | CAGAAGAACAGCTCAGGGACCCCT | SEQ ID NO: 665 |
| | | RPr | CAGGCCTCAGTTCCTTCAGT | SEQ ID NO: 666 |
| EDN1 endothelin | NM_001955.1 | FPr | TGCCACCTGGACATCATTTG | SEQ ID NO: 667 |
| | | Probe | CACTCCCGAGCACGTTGTTCCGT | SEQ ID NO: 668 |
| | | RPr | TGGACCTAGGGCTTCCAAGTC | SEQ ID NO: 669 |
| EFNA1 | NM_004428.2 | FPr | TACATCTCCAAACCCATCCA | SEQ ID NO: 670 |
| | | Probe | CAACCTCAAGCAGCGGTCTTCATG | SEQ ID NO: 671 |
| | | RPr | TTGCCACTGACAGTCACCTT | SEQ ID NO: 672 |
| EFNA3 | NM_004952.3 | FPr | ACTACATCTCCACGCCCACT | SEQ ID NO: 673 |
| | | Probe | CCTCAGACACTTCCAGTGCAGGTTG | SEQ ID NO: 674 |
| | | RPr | CAGCAGACGAACACCTTCAT | SEQ ID NO: 675 |
| EFNB1 | NM_004429.3 | FPr | GGAGCCCGTATCCTGGAG | SEQ ID NO: 676 |
| | | Probe | CCCTCAACCCCAAGTTCCTGAGTG | SEQ ID NO: 677 |
| | | RPr | GGATAGATCACCAAGCCCTTC | SEQ ID NO: 678 |
| EFNB2 | NM_004093.2 | FPr | TGACATTATCATCCCGCTAAGGA | SEQ ID NO: 679 |
| | | Probe | CGGACAGCGTCTTCTGCCCTCACT | SEQ ID NO: 680 |
| | | RPr | GTAGTCCCCGCTGACCTTCT | SEQ ID NO: 681 |
| EFP | NM_005082.2 | FPr | TTGAACAGAGCCTGACCAAG | SEQ ID NO: 682 |
| | | Probe | TGATGCTTTCTCCAGAAACTCGAACTCA | SEQ ID NO: 683 |
| | | RPr | TGTTGAGATTCCTCGCAGTT | SEQ ID NO: 684 |

TABLE A-continued

| Gene | Accession | Reagt | Sequence | SEQ ID NO |
|---|---|---|---|---|
| EGFR | NM_005228.1 | FPr | TGTCGATGGACTTCCAGAAC | SEQ ID NO: 685 |
| | | Probe | CACCTGGGCAGCTGCCAA | SEQ ID NO: 686 |
| | | RPr | ATTGGGACAGCTTGGATCA | SEQ ID NO: 687 |
| EGLN1 | NM_022051.1 | FPr | TCAATGGCCGGACGAAAG | SEQ ID NO: 688 |
| | | Probe | CATTGCCCGGATAACAAGCAACCATG | SEQ ID NO: 689 |
| | | RPr | TTTGGATTATCAACATGACGTACATAAC | SEQ ID NO: 690 |
| EGLN3 | NM_022073.2 | FPr | GCTGGTCCTCTACTGCGG | SEQ ID NO: 691 |
| | | Probe | CCGGCTGGGCAAATACTACGTCAA | SEQ ID NO: 692 |
| | | RPr | CCACCATTGCCTTAGACCTC | SEQ ID NO: 693 |
| EGR1 | NM_001964.2 | FPr | GTCCCCGCTGCAGATCTCT | SEQ ID NO: 694 |
| | | Probe | CGGATCCTTTCCTCACTCGCCCA | SEQ ID NO: 695 |
| | | RPr | CTCCAGCTTAGGGTAGTTGTCCAT | SEQ ID NO: 696 |
| EGR3 | NM_004430.2 | FPr | CCATGTGGATGAATGAGGTG | SEQ ID NO: 697 |
| | | Probe | ACCCAGTCTCACCTTCTCCCCACC | SEQ ID NO: 698 |
| | | RPr | TGCCTGAGAAGAGGTGAGGT | SEQ ID NO: 699 |
| EI24 | NM_004879.2 | FPr | AAAGTGGTGAATGCCATTTG | SEQ ID NO: 700 |
| | | Probe | CCTCAAATGCCAGGTCAGCTATATCCTG | SEQ ID NO: 701 |
| | | RPr | GTGAGGCTTCCTCCCTGATA | SEQ ID NO: 702 |
| EIF4E | NM_001968.1 | FPr | GATCTAAGATGGCGACTGTCGAA | SEQ ID NO: 703 |
| | | Probe | ACCACCCCTACTCCTAATCCCCCGACT | SEQ ID NO: 704 |
| | | RPr | TTAGATTCCGTTTTCTCCTCTTCTG | SEQ ID NO: 705 |
| EIF4EL3 | NM_004846.1 | FPr | AAGCCGCGGTTGAATGTG | SEQ ID NO: 706 |
| | | Probe | TGACCCTCTCCCTCTCTGGATGGCA | SEQ ID NO: 707 |
| | | RPr | TGACGCCAGCTTCAATGATG | SEQ ID NO: 708 |
| ELAVL1 | NM_001419.2 | FPr | GACAGGAGGCCTCTATCCTG | SEQ ID NO: 709 |
| | | Probe | CACCCCACCCTCCACCTCAATC | SEQ ID NO: 710 |
| | | RPr | GTGAGGTAGGTCTGGGGAAG | SEQ ID NO: 711 |
| EMP1 | NM_001423.1 | FPr | GCTAGTACTTTGATGCTCCCTTGAT | SEQ ID NO: 712 |
| | | Probe | CCAGAGAGCCTCCCTGCAGCCA | SEQ ID NO: 713 |
| | | RPr | GAACAGCTGGAGGCCAAGTC | SEQ ID NO: 714 |
| EMR3 | NM_032571.2 | FPr | TGGCCTACCTCTTCACCATC | SEQ ID NO: 715 |
| | | Probe | TCAACAGCCTCCAAGGCTTCTTCA | SEQ ID NO: 716 |
| | | RPr | TGAGGAGGCAGTAGACCAAGA | SEQ ID NO: 717 |
| EMS1 | NM_005231.2 | FPr | GGCAGTGTCACTGAGTCCTTGA | SEQ ID NO: 718 |
| | | Probe | ATCCTCCCCTGCCCCGCG | SEQ ID NO: 719 |
| | | RPr | TGCACTGTGCGTCCCAAT | SEQ ID NO: 720 |
| ENO1 | NM_001428.2 | FPr | CAAGGCCGTGAACGAGAAGT | SEQ ID NO: 721 |
| | | Probe | CTGCAACTGCCTCCTGCTCAAAGTCA | SEQ ID NO: 722 |
| | | RPr | CGGTCACGGAGCCAATCT | SEQ ID NO: 723 |
| EP300 | NM_001429.1 | FPr | AGCCCCAGCAACTACAGTCT | SEQ ID NO: 724 |
| | | Probe | CACTGACATCATGGCTGGCCTTG | SEQ ID NO: 725 |
| | | RPr | TGTTCAAAGGTTGACCATGC | SEQ ID NO: 726 |
| EPAS1 | NM_001430.3 | FPr | AAGCCTTGGAGGGTTTCATTG | SEQ ID NO: 727 |
| | | Probe | TGTCGCCATCTTGGGTCACCACG | SEQ ID NO: 728 |
| | | RPr | TGCTGATGTTTTCTGACAGAAAGAT | SEQ ID NO: 729 |
| EpCAM | NM_002354.1 | FPr | GGGCCCTCCAGAACAATGAT | SEQ ID NO: 730 |
| | | Probe | CCGCTCTCATCGCAGTCAGGATCAT | SEQ ID NO: 731 |
| | | RPr | TGCACTGCTTGGCCTTAAAGA | SEQ ID NO: 732 |
| EPHA2 | NM_004431.2 | FPr | CGCCTGTTCACCAAGATTGAC | SEQ ID NO: 733 |
| | | Probe | TGCGCCCGATGAGATCACCG | SEQ ID NO: 734 |
| | | RPr | GTGGCGTGCCTCGAAGTC | SEQ ID NO: 735 |
| EPHB2 | NM_004442.4 | FPr | CAACCAGGCAGCTCCATC | SEQ ID NO: 736 |
| | | Probe | CACCTGATGCATGATGGACACTGC | SEQ ID NO: 737 |
| | | RPr | GTAATGCTGTCCACGGTGC | SEQ ID NO: 738 |
| EPHB4 | NM_004444.3 | FPr | TGAACGGGGTATCCTCCTTA | SEQ ID NO: 739 |
| | | Probe | CGTCCCATTTGAGCCTGTCAATGT | SEQ ID NO: 740 |
| | | RPr | AGGTACCTCTCGGTCAGTGG | SEQ ID NO: 741 |

TABLE A-continued

| Gene | Accession | Reagt | Sequence | SEQ ID NO |
|---|---|---|---|---|
| EphB6 | NM_004445.1 | FPr | ACTGGTCCTCCATCGGCT | SEQ ID NO: 742 |
| | | Probe | CCTTGCACCTCAAACCAAAGCTCC | SEQ ID NO: 743 |
| | | RPr | CCAGTGTAGCATGAGTGCTGA | SEQ ID NO: 744 |
| EPM2A | NM_005670.2 | FPr | ACTGTGGCACTTAGGGGAGA | SEQ ID NO: 745 |
| | | Probe | CTGCCTCTGCCCAAAGCAAATGTC | SEQ ID NO: 746 |
| | | RPr | AGTGGAAATGTGTCCTGGCT | SEQ ID NO: 747 |
| ErbB3 | NM_001982.1 | FPr | CGGTTATGTCATGCCAGATACAC | SEQ ID NO: 748 |
| | | Probe | CCTCAAAGGTACTCCTCCTCCCGG | SEQ ID NO: 749 |
| | | RPr | GAACTGAGACCCACTGAAGAAAGG | SEQ ID NO: 750 |
| ERCC1 | NM_001983.1 | FPr | GTCCAGGTGGATGTGAAAGA | SEQ ID NO: 751 |
| | | Probe | CAGCAGGCCCTCAAGGAGCTG | SEQ ID NO: 752 |
| | | RPr | CGGCCAGGATACACATCTTA | SEQ ID NO: 753 |
| ERCC2 | NM_000400.2 | FPr | TGGCCTTCTTCACCAGCTA | SEQ ID NO: 754 |
| | | Probe | AGGCCACGGTGCTCTCCATGTACT | SEQ ID NO: 755 |
| | | RPr | CAAGGATCCCCTGCTCATAC | SEQ ID NO: 756 |
| EREG | NM_001432.1 | FPr | ATAACAAAGTGTAGCTCTGACATGAATG | SEQ ID NO: 757 |
| | | Probe | TTGTTTGCATGGACAGTGCATCTATCTGGT | SEQ ID NO: 758 |
| | | RPr | CACACCTGCAGTAGTTTTGACTCA | SEQ ID NO: 759 |
| ERK1 | Z11696.1 | FPr | ACGGATCACAGTGGAGGAAG | SEQ ID NO: 760 |
| | | Probe | CGCTGGCTCACCCCTACCTG | SEQ ID NO: 761 |
| | | RPr | CTCATCCGTCGGGTCATAGT | SEQ ID NO: 762 |
| ERK2 | NM_002745.1 | FPr | AGTTCTTGACCCCTGGTCCT | SEQ ID NO: 763 |
| | | Probe | TCTCCAGCCCGTCTTGGCTT | SEQ ID NO: 764 |
| | | RPr | AAACGGCTCAAAGGAGTCAA | SEQ ID NO: 765 |
| ESPL1 | NM_012291.1 | FPr | ACCCCCAGACCGGATCAG | SEQ ID NO: 766 |
| | | Probe | CTGGCCCTCATGTCCCCTTCACG | SEQ ID NO: 767 |
| | | RPr | TGTAGGGCAGACTTCCTCAAACA | SEQ ID NO: 768 |
| EstR1 | NM_000125.1 | FPr | CGTGGTGCCCCTCTATGAC | SEQ ID NO: 769 |
| | | Probe | CTGGAGATGCTGGACGCCC | SEQ ID NO: 770 |
| | | RPr | GGCTAGTGGGCGCATGTAG | SEQ ID NO: 771 |
| ETV4 | NM_001986.1 | FPr | TCCAGTGCCTATGACCCC | SEQ ID NO: 772 |
| | | Probe | CAGACAAATCGCCATCAAGTCCCC | SEQ ID NO: 773 |
| | | RPr | ACTGTCCAAGGGCACCAG | SEQ ID NO: 774 |
| F3 | NM_001993.2 | FPr | GTGAAGGATGTGAAGCAGACGTA | SEQ ID NO: 775 |
| | | Probe | TGGCACGGGTCTTCTCCTACC | SEQ ID NO: 776 |
| | | RPr | AACCGGTGCTCTCCACATTC | SEQ ID NO: 777 |
| FABP4 | NM_001442.1 | FPr | GCTTTGCCACCAGGAAAGT | SEQ ID NO: 778 |
| | | Probe | CTGGCATGGCCAAACCTAACATGA | SEQ ID NO: 779 |
| | | RPr | CATCCCCATTCACACTGATG | SEQ ID NO: 780 |
| FAP | NM_004460.2 | FPr | CTGACCAGAACCACGGCT | SEQ ID NO: 781 |
| | | Probe | CGGCCTGTCCACGAACCACTTATA | SEQ ID NO: 782 |
| | | RPr | GGAAGTGGGTCATGTGGG | SEQ ID NO: 783 |
| fas | NM_000043.1 | FPr | GGATTGCTCAACAACCATGCT | SEQ ID NO: 784 |
| | | Probe | TCTGGACCCTCCTACCTCTGGTTCTTACGCT | SEQ ID NO: 785 |
| | | RPr | GGCATTAACACTTTTGGACGATAA | SEQ ID NO: 786 |
| fasl | NM_000639.1 | FPr | GCACTTTGGGATTCTTTCCATTAT | SEQ ID NO: 787 |
| | | Probe | ACAACATTCTCGGTGCCTGTAACAAAGAA | SEQ ID NO: 788 |
| | | RPr | GCATGTAAGAAGACCCTCACTGAA | SEQ ID NO: 789 |
| FASN | NM_004104.4 | FPr | GCCTCTTCCTGTTCGACG | SEQ ID NO: 790 |
| | | Probe | TCGCCCACCTACGTACTGGCCTAC | SEQ ID NO: 791 |
| | | RPr | GCTTTGCCCGGTAGCTCT | SEQ ID NO: 792 |
| FBXO5 | NM_012177.2 | FPr | GGCTATTCCTCATTTTCTCTACAAAGTG | SEQ ID NO: 793 |
| | | Probe | CCTCCAGGAGGCTACCTTCTTCATGTTCAC | SEQ ID NO: 794 |
| | | RPr | GGATTGTAGACTGTCACCGAAATTC | SEQ ID NO: 795 |
| FBXW7 | NM_033632.1 | FPr | CCCCAGTTTCAACGAGACTT | SEQ ID NO: 796 |
| | | Probe | TCATTGCTCCCTAAAGAGTTGGCACTC | SEQ ID NO: 797 |
| | | RPr | GTTCCAGGAATGAAAGCACA | SEQ ID NO: 798 |

TABLE A-continued

| Gene | Accession | Reagt | Sequence | SEQ ID NO |
|---|---|---|---|---|
| FDXR | NM_004110.2 | FPr | GAGATGATTCAGTTACCGGGAG | SEQ ID NO: 799 |
| | | Probe | AATCCACAGGATCCAAAATGGGCC | SEQ ID NO: 800 |
| | | RPr | ATCTTGTCCTGGAGACCCAA | SEQ ID NO: 801 |
| FES | NM_002005.2 | FPr | CTCTGCAGGCCTAGGTGC | SEQ ID NO: 802 |
| | | Probe | CTCCTCAGCGGCTCCAGCTCATAT | SEQ ID NO: 803 |
| | | RPr | CCAGGACTGTGAAGAGCTGTC | SEQ ID NO: 804 |
| FGF18 | NM_003862.1 | FPr | CGGTAGTCAAGTCCGGATCAA | SEQ ID NO: 805 |
| | | Probe | CAAGGAGACGGAATTCTACCTGTGC | SEQ ID NO: 806 |
| | | RPr | GCTTGCCTTTGCGGTTCA | SEQ ID NO: 807 |
| FGF2 | NM_002006.2 | FPr | AGATGCAGGAGAGAGGAGC | SEQ ID NO: 808 |
| | | Probe | CCTGCAGACTGCTTTTTGCCCAAT | SEQ ID NO: 809 |
| | | RPr | GTTTTGCAGCCTTACCCAAT | SEQ ID NO: 810 |
| FGFR1 | NM_023109.1 | FPr | CACGGGACATTCACCACATC | SEQ ID NO: 811 |
| | | Probe | ATAAAAAGACAACCAACGGCCGACTGC | SEQ ID NO: 812 |
| | | RPr | GGGTGCCATCCACTTCACA | SEQ ID NO: 813 |
| FGFR2 isoform 1 | NM_000141.2 | FPr | GAGGGACTGTTGGCATGCA | SEQ ID NO: 814 |
| | | Probe | TCCCAGAGACCAACGTTCAAGCAGTTG | SEQ ID NO: 815 |
| | | RPr | GAGTGAGAATTCGATCCAAGTCTTC | SEQ ID NO: 816 |
| FHIT | NM_002012.1 | FPr | CCAGTGGAGCGCTTCCAT | SEQ ID NO: 817 |
| | | Probe | TCGGCCACTTCATCAGGACGCAG | SEQ ID NO: 818 |
| | | RPr | CTCTCTGGGTCGTCTGAAACAA | SEQ ID NO: 819 |
| FIGF | NM_004469.2 | FPr | GGTTCCAGCTTTCTGTAGCTGT | SEQ ID NO: 820 |
| | | Probe | ATTGGTGGCCACACCACCTCCTTA | SEQ ID NO: 821 |
| | | RPr | GCCGCAGGTTCTAGTTGCT | SEQ ID NO: 822 |
| FLJ12455 | NM_022078.1 | FPr | CCACCAGCATGAAGTTTCG | SEQ ID NO: 823 |
| | | Probe | ACCCCTCACAAAGGCCATGTCTGT | SEQ ID NO: 824 |
| | | RPr | GGCTGTCTGAAGCACAACTG | SEQ ID NO: 825 |
| FLJ20712 | AK000719.1 | FPr | GCCACACAAACATGCTCCT | SEQ ID NO: 826 |
| | | Probe | ATGTCTTTCCCAGCAGCTCTGCCT | SEQ ID NO: 827 |
| | | RPr | GCCACAGGAAACTTCCGA | SEQ ID NO: 828 |
| FLT1 | NM_002019.1 | FPr | GGCTCCCGAATCTATCTTTG | SEQ ID NO: 829 |
| | | Probe | CTACAGCACCAAGAGCGACGTGTG | SEQ ID NO: 830 |
| | | RPr | TCCCACAGCAATACTCCGTA | SEQ ID NO: 831 |
| FLT4 | NM_002020.1 | FPr | ACCAAGAAGCTGAGGACCTG | SEQ ID NO: 832 |
| | | Probe | AGCCCGCTGACCATGGAAGATCT | SEQ ID NO: 833 |
| | | RPr | CCTGGAAGCTGTAGCAGACA | SEQ ID NO: 834 |
| FOS | NM_005252.2 | FPr | CGAGCCCTTTGATGACTTCCT | SEQ ID NO: 835 |
| | | Probe | TCCCAGCATCATCCAGGCCCAG | SEQ ID NO: 836 |
| | | RPr | GGAGCGGGCTGTCTCAGA | SEQ ID NO: 837 |
| FOXO3A | NM_001455.1 | FPr | TGAAGTCCAGGACGATGATG | SEQ ID NO: 838 |
| | | Probe | CTCTACAGCAGCTCAGCCAGCCTG | SEQ ID NO: 839 |
| | | RPr | ACGGCTTGCTTACTGAAGGT | SEQ ID NO: 840 |
| FPGS | NM_004957.3 | FPr | CAGCCCTGCCAGTTTGAC | SEQ ID NO: 841 |
| | | Probe | ATGCCGTCTTCTGCCCTAACTGA | SEQ ID NO: 842 |
| | | RPr | GTTGCCTGTGGATGACACC | SEQ ID NO: 843 |
| FRP1 | NM_003012.2 | FPr | TTGGTACCTGTGGGTTAGCA | SEQ ID NO: 844 |
| | | Probe | TCCCCAGGGTAGAATTCAATCAGAGC | SEQ ID NO: 845 |
| | | RPr | CACATCCAAATGCAAACTGG | SEQ ID NO: 846 |
| FST | NM_006350.2 | FPr | GTAAGTCGGATGAGCCTGTCTGT | SEQ ID NO: 847 |
| | | Probe | CCAGTGACAATGCCACTTATGCCAGC | SEQ ID NO: 848 |
| | | RPr | CAGCTTCCTTCATGGCACACT | SEQ ID NO: 849 |
| Furin | NM_002569.1 | FPr | AAGTCCTCGATACGCACTATAGCA | SEQ ID NO: 850 |
| | | Probe | CCCGGATGGTCTCCACGTCAT | SEQ ID NO: 851 |
| | | RPr | CTGGCATGTGGCACATGAG | SEQ ID NO: 852 |
| FUS | NM_004960.1 | FPr | GGATAATTCAGACAACAACACCATCT | SEQ ID NO: 853 |
| | | Probe | TCAATTGTAACATTCTCACCCAGGCCTTG | SEQ ID NO: 854 |
| | | RPr | TGAAGTAATACAGCCACAGACTCAAT | SEQ ID NO: 855 |

TABLE A-continued

| Gene | Accession | Reagt | Sequence | SEQ ID NO |
|---|---|---|---|---|
| FUT1 | NM_000148.1 | FPr | CCGTGCTCATTGCTAACCA | SEQ ID NO: 856 |
| | | Probe | TCTGTCCCTGAACTCCCAGAACCA | SEQ ID NO: 857 |
| | | RPr | CTGCCCAAAGCCAGATGTA | SEQ ID NO: 858 |
| FUT3 | NM_000149.1 | FPr | CAGTTCGGTCCAACAGAGAA | SEQ ID NO: 859 |
| | | Probe | AGCAGGCAACCACCATGTCATTTG | SEQ ID NO: 860 |
| | | RPr | TGCGAATTATATCCCGATGA | SEQ ID NO: 861 |
| FUT6 | NM_000150.1 | FPr | CGTGTGTCTCAAGACGATCC | SEQ ID NO: 862 |
| | | Probe | TGTGTACCCTAATGGGTCCCGCTT | SEQ ID NO: 863 |
| | | RPr | GGTCCCTGTGCTGTCTGG | SEQ ID NO: 864 |
| FXYD5 | NM_014164.4 | FPr | AGAGCACCAAAGCAGCTCAT | SEQ ID NO: 865 |
| | | Probe | CACTGATGACACCACGACGCTCTC | SEQ ID NO: 866 |
| | | RPr | GTGCTTGGGGATGGTCTCT | SEQ ID NO: 867 |
| FYN | NM_002037.3 | FPr | GAAGCGCAGATCATGAAGAA | SEQ ID NO: 868 |
| | | Probe | CTGAAGCACGACAAGCTGGTCCAG | SEQ ID NO: 869 |
| | | RPr | CTCCTCAGACACCACTGCAT | SEQ ID NO: 870 |
| FZD1 | NM_003505.1 | FPr | GGTGCACCAGTTCTACCCTC | SEQ ID NO: 871 |
| | | Probe | ACTTGAGCTCAGCGGAACACTGCA | SEQ ID NO: 872 |
| | | RPr | GCGTACATGGAGCACAGGA | SEQ ID NO: 873 |
| FZD2 | NM_001466.2 | FPr | TGGATCCTCACCTGGTCG | SEQ ID NO: 874 |
| | | Probe | TGCGCTTCCACCTTCTTCACTGTC | SEQ ID NO: 875 |
| | | RPr | GCGCTGCATGTCTACCAA | SEQ ID NO: 876 |
| FZD6 | NM_003506.2 | FPr | AATGAGAGAGGTGAAAGCGG | SEQ ID NO: 877 |
| | | Probe | CGGAGCTAGCACCCCCAGGTTAAG | SEQ ID NO: 878 |
| | | RPr | AGGTTCACCACAGTCCTGTTC | SEQ ID NO: 879 |
| G-Catenin | NM_002230.1 | FPr | TCAGCAGCAAGGGCATCAT | SEQ ID NO: 880 |
| | | Probe | CGCCCGCAGGCCTCATCCT | SEQ ID NO: 881 |
| | | RPr | GGTGGTTTTCTTGAGCGTGTACT | SEQ ID NO: 882 |
| G1P2 | NM_005101.1 | FPr | CAACGAATTCCAGGTGTCC | SEQ ID NO: 883 |
| | | Probe | CTGAGCAGCTCCATGTCGGTGTC | SEQ ID NO: 884 |
| | | RPr | GATCTGCGCCTTCAGCTC | SEQ ID NO: 885 |
| GADD45 | NM_001924.2 | FPr | GTGCTGGTGACGAATCCA | SEQ ID NO: 886 |
| | | Probe | TTCATCTCAATGGAAGGATCCTGCC | SEQ ID NO: 887 |
| | | RPr | CCCGGCAAAAACAAATAAGT | SEQ ID NO: 888 |
| GADD45B | NM_015675.1 | FPr | ACCCTCGACAAGACCACACT | SEQ ID NO: 889 |
| | | Probe | AACTTCAGCCCCAGCTCCCAAGTC | SEQ ID NO: 890 |
| | | RPr | TGGGAGTTCATGGGTACAGA | SEQ ID NO: 891 |
| GADD45G | NM_006705.2 | FPr | CGCGCTGCAGATCCATTT | SEQ ID NO: 892 |
| | | Probe | CGCTGATCCAGGCTTTCTGCTGC | SEQ ID NO: 893 |
| | | RPr | CGCACTATGTCGATGTCGTTCT | SEQ ID NO: 894 |
| GAGE4 | NM_001474.1 | FPr | GGAACAGGGTCACCCACAGA | SEQ ID NO: 895 |
| | | Probe | TCAGGACCATCTTCACACTCACACCA | SEQ ID NO: 896 |
| | | RPr | GATTTGGCGGGTCCATCTC | SEQ ID NO: 897 |
| GBP1 | NM_002053.1 | FPr | TTGGGAAATATTTGGGCATT | SEQ ID NO: 898 |
| | | Probe | TTGGGACATTGTAGACTTGGCCAGAC | SEQ ID NO: 899 |
| | | RPr | AGAAGCTAGGGTGGTTGTCC | SEQ ID NO: 900 |
| GBP2 | NM_004120.2 | FPr | GCATGGGAACCATCAACCA | SEQ ID NO: 901 |
| | | Probe | CCATGGACCAACTTCACTATGTGACAGAGC | SEQ ID NO: 902 |
| | | RPr | TGAGGAGTTTGCCTTGATTCG | SEQ ID NO: 903 |
| GCLC | NM_001498.1 | FPr | CTGTTGCAGGAAGGCATTGA | SEQ ID NO: 904 |
| | | Probe | CATCTCCTGGCCCAGCATGTT | SEQ ID NO: 905 |
| | | RPr | GTCAGTGGGTCTCTAATAAAGAGATGAG | SEQ ID NO: 906 |
| GCLM | NM_002061.1 | FPr | TGTAGAATCAAACTCTTCATCATCAACTAG | SEQ ID NO: 907 |
| | | Probe | TGCAGTTGACATGGCCTGTTCAGTCC | SEQ ID NO: 908 |
| | | RPr | CACAGAATCCAGCTGTGCAACT | SEQ ID NO: 909 |
| GCNT1 | NM_001490.3 | FPr | TGGTGCTTGGAGCATAGAAG | SEQ ID NO: 910 |
| | | Probe | TGCCCTTCACAAAGGAAATCCCTG | SEQ ID NO: 911 |
| | | RPr | GCAACGTCCTCAGCATTTC | SEQ ID NO: 912 |

TABLE A-continued

| Gene | Accession | Reagt | Sequence | SEQ ID NO |
|---|---|---|---|---|
| GDF15 | NM_004864.1 | FPr | CGCTCCAGACCTATGATGACT | SEQ ID NO: 913 |
| | | Probe | TGTTAGCCAAAGACTGCCACTGCA | SEQ ID NO: 914 |
| | | RPr | ACAGTGGAAGGACCAGGACT | SEQ ID NO: 915 |
| GIT1 | NM_014030.2 | FPr | GTGTATGACGAGGTGGATCG | SEQ ID NO: 916 |
| | | Probe | AGCCAGCCACACTGCATCATTTTC | SEQ ID NO: 917 |
| | | RPr | ACCAGAGTGCTGTGGTTTTG | SEQ ID NO: 918 |
| GJA1 | NM_000165.2 | FPr | GTTCACTGGGGGTGTATGG | SEQ ID NO: 919 |
| | | Probe | ATCCCCTCCCTCTCCACCCATCTA | SEQ ID NO: 920 |
| | | RPr | AAATACCAACATGCACCTCTCTT | SEQ ID NO: 921 |
| GJB2 | NM_004004.3 | FPr | TGTCATGTACGACGGCTTCT | SEQ ID NO: 922 |
| | | Probe | AGGCGTTGCACTTCACCAGCC | SEQ ID NO: 923 |
| | | RPr | AGTCCACAGTGTTGGGACAA | SEQ ID NO: 924 |
| GPX1 | NM_000581.2 | FPr | GCTTATGACCGACCCCAA | SEQ ID NO: 925 |
| | | Probe | CTCATCACCTGGTCTCCGGTGTGT | SEQ ID NO: 926 |
| | | RPr | AAAGTTCCAGGCAACATCGT | SEQ ID NO: 927 |
| GPX2 | NM_002083.1 | FPr | CACACAGATCTCCTACTCCATCCA | SEQ ID NO: 928 |
| | | Probe | CATGCTGCATCCTAAGGCTCCTCAGG | SEQ ID NO: 929 |
| | | RPr | GGTCCAGCAGTGTCTCCTGAA | SEQ ID NO: 930 |
| Grb10 | NM_005311.2 | FPr | CTTCGCCTTTGCTGATTGC | SEQ ID NO: 931 |
| | | Probe | CTCCAAACGCCTGCCTGACGACTG | SEQ ID NO: 932 |
| | | RPr | CCATAACGCACATGCTCCAA | SEQ ID NO: 933 |
| GRB14 | NM_004490.1 | FPr | TCCCACTGAAGCCCTTTCAG | SEQ ID NO: 934 |
| | | Probe | CCTCCAAGCGAGTCCTTCTTCAACCG | SEQ ID NO: 935 |
| | | RPr | AGTGCCCAGGCGTAAACATC | SEQ ID NO: 936 |
| GRB2 | NM_002086.2 | FPr | GTCCATCAGTGCATGACGTT | SEQ ID NO: 937 |
| | | Probe | AGGCCACGTATAGTCCTAGCTGACGC | SEQ ID NO: 938 |
| | | RPr | AGCCCACTTGGTTTCTTGTT | SEQ ID NO: 939 |
| GRB7 | NM_005310.1 | FPr | CCATCTGCATCCATCTTGTT | SEQ ID NO: 940 |
| | | Probe | CTCCCCACCCTTGAGAAGTGCCT | SEQ ID NO: 941 |
| | | RPr | GGCCACCAGGGTATTATCTG | SEQ ID NO: 942 |
| GRIK1 | NM_000830.2 | FPr | GTTGGGTGCATCTCTCGG | SEQ ID NO: 943 |
| | | Probe | AATTCATGCCGAGATACAGCCGCT | SEQ ID NO: 944 |
| | | RPr | CGTGCTCCATCTTCCTAGCTT | SEQ ID NO: 945 |
| GRO1 | NM_001511.1 | FPr | CGAAAAGATGCTGAACAGTGACA | SEQ ID NO: 946 |
| | | Probe | CTTCCTCCTCCCTTCTGGTCAGTTGGAT | SEQ ID NO: 947 |
| | | RPr | TCAGGAACAGCCACCAGTGA | SEQ ID NO: 948 |
| GRP | NM_002091.1 | FPr | CTGGGTCTCATAGAAGCAAAGGA | SEQ ID NO: 949 |
| | | Probe | AGAAACCACCAGCCACCTCAACCCA | SEQ ID NO: 950 |
| | | RPr | CCACGAAGGCTGCTGATTG | SEQ ID NO: 951 |
| GRPR | NM_005314.1 | FPr | ATGCTGCTGGCCATTCCA | SEQ ID NO: 952 |
| | | Probe | CCGTGTTTTCTGACCTCCATCCCTTCC | SEQ ID NO: 953 |
| | | RPr | AGGTCTGGTTGGTGCTTTCCT | SEQ ID NO: 954 |
| GSK3B | NM_002093.2 | FPr | GACAAGGACGGCAGCAAG | SEQ ID NO: 955 |
| | | Probe | CCAGGAGTTGCCACCACTGTTGTC | SEQ ID NO: 956 |
| | | RPr | TTGTGGCCTGTCTGGACC | SEQ ID NO: 957 |
| GSTA3 | NM_000847.3 | FPr | TCTCCAACTTCCCTCTGCTG | SEQ ID NO: 958 |
| | | Probe | AGGCCCTGAAAACCAGAATCAGCA | SEQ ID NO: 959 |
| | | RPr | ACTTCTTCACCGTGGGCA | SEQ ID NO: 960 |
| GSTM1 | NM_000561.1 | FPr | AAGCTATGAGGAAAAGAAGTACACGAT | SEQ ID NO: 961 |
| | | Probe | TCAGCCACTGGCTTCTGTCATAATCAGGAG | SEQ ID NO: 962 |
| | | RPr | GGCCCAGCTTGAATTTTTCA | SEQ ID NO: 963 |
| GSTM3 | NM_000849.3 | FPr | CAATGCCATCTTGCGCTACAT | SEQ ID NO: 964 |
| | | Probe | CTCGCAAGCACAACATGTGTGGTGAGA | SEQ ID NO: 965 |
| | | RPr | GTCCACTCGAATCTTTTCTTCTTCA | SEQ ID NO: 966 |
| GSTp | NM_000852.2 | FPr | GAGACCCTGCTGTCCCAGAA | SEQ ID NO: 967 |
| | | Probe | TCCCACAATGAAGGTCTTGCCTCCCT | SEQ ID NO: 968 |
| | | RPr | GGTTGTAGTCAGCGAAGGAGATC | SEQ ID NO: 969 |

TABLE A-continued

| Gene | Accession | Reagt | Sequence | SEQ ID NO |
|---|---|---|---|---|
| GSTT1 | NM_000853.1 | FPr | CACCATCCCCACCCTGTCT | SEQ ID NO: 970 |
| | | Probe | CACAGCCGCCTGAAAGCCACAAT | SEQ ID NO: 971 |
| | | RPr | GGCCTCAGTGTGCATCATTCT | SEQ ID NO: 972 |
| H2AFZ | NM_002106.2 | FPr | CCGGAAAGGCCAAGACAA | SEQ ID NO: 973 |
| | | Probe | CCCGCTCGCAGAGAGCCGG | SEQ ID NO: 974 |
| | | RPr | AATACGGCCCACTGGGAACT | SEQ ID NO: 975 |
| HB-EGF | NM_001945.1 | FPr | GACTCCTTCGTCCCCAGTTG | SEQ ID NO: 976 |
| | | Probe | TTGGGCCTCCCATAATTGCTTTGCC | SEQ ID NO: 977 |
| | | RPr | TGGCACTTGAAGGCTCTGGTA | SEQ ID NO: 978 |
| hCRA a | U78556.1 | FPr | TGACACCCTTACCTTCCTGAGAA | SEQ ID NO: 979 |
| | | Probe | TCTGCTTTCCGCGCTCCCAGG | SEQ ID NO: 980 |
| | | RPr | AAAAACACGAGTCAAAAATAGAAGTCACT | SEQ ID NO: 981 |
| HDAC1 | NM_004964.2 | FPr | CAAGTACCACAGCGATGACTACATTAA | SEQ ID NO: 982 |
| | | Probe | TTCTTGCGCTCCATCCGTCCAGA | SEQ ID NO: 983 |
| | | RPr | GCTTGCTGTACTCCGACATGTT | SEQ ID NO: 984 |
| HDAC2 | NM_001527.1 | FPr | GGTGGCTACACAATCCGTAA | SEQ ID NO: 985 |
| | | Probe | TGCAGTCTCATATGTCCAACATCGAGC | SEQ ID NO: 986 |
| | | RPr | TGGGAATCTCACAATCAAGG | SEQ ID NO: 987 |
| HDGF | NM_004494.1 | FPr | TCCTAGGCATTCTGGACCTC | SEQ ID NO: 988 |
| | | Probe | CATTCCTACCCCTGATCCCAACCC | SEQ ID NO: 989 |
| | | RPr | GCTGTTGATGCTCCATCCTT | SEQ ID NO: 990 |
| hENT1 | NM_004955.1 | FPr | AGCCGTGACTGTTGAGGTC | SEQ ID NO: 991 |
| | | Probe | AAGTCCAGCATCGCAGGCAGC | SEQ ID NO: 992 |
| | | RPr | AAGTAACGTTCCCAGGTGCT | SEQ ID NO: 993 |
| Hepsin | NM_002151.1 | FPr | AGGCTGCTGGAGGTCATCTC | SEQ ID NO: 994 |
| | | Probe | CCAGAGGCCGTTTCTTGGCCG | SEQ ID NO: 995 |
| | | RPr | CTTCCTGCGGCACAGTCT | SEQ ID NO: 996 |
| HER2 | NM_004448.1 | FPr | CGGTGTGAGAAGTGCAGCAA | SEQ ID NO: 997 |
| | | Probe | CCAGACCATAGCACACTCGGGCAC | SEQ ID NO: 998 |
| | | RPr | CCTCTCGCAAGTGCTCCAT | SEQ ID NO: 999 |
| Herstatin | AF177761.2 | FPr | CACCCTGTCCTATCCTTCCT | SEQ ID NO: 1000 |
| | | Probe | CCCTCTTGGGACCTAGTCTCTGCCT | SEQ ID NO: 1001 |
| | | RPr | GGCCAGGGGTAGAGAGTAGA | SEQ ID NO: 1002 |
| HES6 | NM_018645.3 | FPr | TTAGGGACCCTGCAGCTCT | SEQ ID NO: 1003 |
| | | Probe | TAGCTCCCTCCCTCCACCCACTC | SEQ ID NO: 1004 |
| | | RPr | CTACAAAATTCTTCCTCCTGCC | SEQ ID NO: 1005 |
| HGF | M29145.1 | FPr | CCGAAATCCAGATGATGATG | SEQ ID NO: 1006 |
| | | Probe | CTCATGGACCCTGGTGCTACACG | SEQ ID NO: 1007 |
| | | RPr | CCCAAGGAATGAGTGGATTT | SEQ ID NO: 1008 |
| HIF1A | NM_001530.1 | FPr | TGAACATAAAGTCTGCAACATGGA | SEQ ID NO: 1009 |
| | | Probe | TTGCACTGCACAGGCCACATTCAC | SEQ ID NO: 1010 |
| | | RPr | TGAGGTTGGTTACTGTTGGTATCATATA | SEQ ID NO: 1011 |
| HK1 | NM_000188.1 | FPr | TACGCACAGAGGCAAGCA | SEQ ID NO: 1012 |
| | | Probe | TAAGAGTCCGGGATCCCCAGCCTA | SEQ ID NO: 1013 |
| | | RPr | GAGAGAAGTGCTGGAGAGGC | SEQ ID NO: 1014 |
| HLA-DPB1 | NM_002121.4 | FPr | TCCATGATGGTTCTGCAGGTT | SEQ ID NO: 1015 |
| | | Probe | CCCCGGACAGTGGCTCTGACG | SEQ ID NO: 1016 |
| | | RPr | TGAGCAGCACCATCAGTAACG | SEQ ID NO: 1017 |
| HLA-DRA | NM_019111.3 | FPr | GACGATTTGCCAGCTTTGAG | SEQ ID NO: 1018 |
| | | Probe | TCAAGGTGCATTGGCCAACATAGC | SEQ ID NO: 1019 |
| | | RPr | TCCAGGTTGGCTTTGTCC | SEQ ID NO: 1020 |
| HLA-DRB1 | NM_002124.1 | FPr | GCTTTCTCAGGACCTGGTTG | SEQ ID NO: 1021 |
| | | Probe | CATTTTCTGCAGTTGCCGAACCAG | SEQ ID NO: 1022 |
| | | RPr | AGGAAGCCACAAGGGAGG | SEQ ID NO: 1023 |
| HLA-G | NM_002127.2 | FPr | CCTGCGCGGCTACTACAAC | SEQ ID NO: 1024 |
| | | Probe | CGAGGCCAGTTCTCACACCCTCCAG | SEQ ID NO: 1025 |
| | | RPr | CAGGTCGCAGCCAATCATC | SEQ ID NO: 1026 |

TABLE A-continued

| Gene | Accession | Reagt | Sequence | SEQ ID NO |
|---|---|---|---|---|
| HMGB1 | NM_002128.3 | FPr | TGGCCTGTCCATTGGTGAT | SEQ ID NO: 1027 |
| | | Probe | TTCCACATCTCTCCCAGTTTCTTCGCAA | SEQ ID NO: 1028 |
| | | RPr | GCTTGTCATCTGCAGCAGTGTT | SEQ ID NO: 1029 |
| hMLH | NM_000249.2 | FPr | CTACTTCCAGCAACCCCAGA | SEQ ID NO: 1030 |
| | | Probe | TCCACATCAGAATCTTCCCG | SEQ ID NO: 1031 |
| | | RPr | CTTTCGGGAATCATCTTCCA | SEQ ID NO: 1032 |
| HNRPAB | NM_004499.2 | FPr | CAAGGGAGCGACCAACTGA | SEQ ID NO: 1033 |
| | | Probe | CTCCATATCCAAACAAAGCATGTGTGCG | SEQ ID NO: 1034 |
| | | RPr | GTTTGCCAAGTTAAATTTGGTACATAAT | SEQ ID NO: 1035 |
| HNRPD | NM_031370.2 | FPr | GCCAGTAAGAACGAGGAGGA | SEQ ID NO: 1036 |
| | | Probe | AAGGCCATTCAAACTCCTCCCCAC | SEQ ID NO: 1037 |
| | | RPr | CGTCGCTGCTTCAGAGTGT | SEQ ID NO: 1038 |
| HoxA1 | NM_005522.3 | FPr | AGTGACAGATGGACAATGCAAGA | SEQ ID NO: 1039 |
| | | Probe | TGAACTCCTTCCTGGAATACCCCA | SEQ ID NO: 1040 |
| | | RPr | CCGAGTCGCCACTGCTAAGT | SEQ ID NO: 1041 |
| HoxA5 | NM_019102.2 | FPr | TCCCTTGTGTTCCTTCTGTGAA | SEQ ID NO: 1042 |
| | | Probe | AGCCCTGTTCTCGTTGCCCTAATTCATC | SEQ ID NO: 1043 |
| | | RPr | GGCAATAAACAGGCTCATGATTAA | SEQ ID NO: 1044 |
| HOXB13 | NM_006361.2 | FPr | CGTGCCTTATGGTTACTTTGG | SEQ ID NO: 1045 |
| | | Probe | ACACTCGGCAGGAGTAGTACCCGC | SEQ ID NO: 1046 |
| | | RPr | CACAGGGTTTCAGCGAGC | SEQ ID NO: 1047 |
| HOXB7 | NM_004502.2 | FPr | CAGCCTCAAGTTCGGTTTTC | SEQ ID NO: 1048 |
| | | Probe | ACCGGAGCCTTCCCAGAACAAACT | SEQ ID NO: 1049 |
| | | RPr | GTTGGAAGCAAACGCACA | SEQ ID NO: 1050 |
| HRAS | NM_005343.2 | FPr | GGACGAATACGACCCCACT | SEQ ID NO: 1051 |
| | | Probe | ACCACCTGCTTCCGGTAGGAATCC | SEQ ID NO: 1052 |
| | | RPr | GCACGTCTCCCCATCAAT | SEQ ID NO: 1053 |
| HSBP1 | NM_001537.1 | FPr | GGAGATGGCCGAGACTGAC | SEQ ID NO: 1054 |
| | | Probe | CAAGACCGTGCAGGACCTCACCT | SEQ ID NO: 1055 |
| | | RPr | CTGCAGGAGTGTCTGCACC | SEQ ID NO: 1056 |
| HSD17B1 | NM_000413.1 | FPr | CTGGACCGCACGGACATC | SEQ ID NO: 1057 |
| | | Probe | ACCGCTTCTACCAATACCTCGCCCA | SEQ ID NO: 1058 |
| | | RPr | CGCCTCGCGAAAGACTTG | SEQ ID NO: 1059 |
| HSD17B2 | NM_002153.1 | FPr | GCTTTCCAAGTGGGGAATTA | SEQ ID NO: 1060 |
| | | Probe | AGTTGCTTCCATCCAACCTGGAGG | SEQ ID NO: 1061 |
| | | RPr | TGCCTGCGATATTGTTAGG | SEQ ID NO: 1062 |
| HSPA1A | NM_005345.4 | FPr | CTGCTGCGACAGTCCACTA | SEQ ID NO: 1063 |
| | | Probe | AGAGTGACTCCCGTTGTCCCAAGG | SEQ ID NO: 1064 |
| | | RPr | CAGGTTCGCTCTGGGAAG | SEQ ID NO: 1065 |
| HSPA1B | NM_005346.3 | FPr | GGTCCGCTTCGTCTTTCGA | SEQ ID NO: 1066 |
| | | Probe | TGACTCCCGCGGTCCCAAGG | SEQ ID NO: 1067 |
| | | RPr | GCACAGGTTCGCTCTGGAA | SEQ ID NO: 1068 |
| HSPA4 | NM_002154.3 | FPr | TTCAGTGTGTCCAGTGCATC | SEQ ID NO: 1069 |
| | | Probe | CATTTTCCTCAGACTTGTGAACCTCCACT | SEQ ID NO: 1070 |
| | | RPr | ATCTGTTTCCATTGGCTCCT | SEQ ID NO: 1071 |
| HSPA5 | NM_005347.2 | FPr | GGCTAGTAGAACTGGATCCCAACA | SEQ ID NO: 1072 |
| | | Probe | TAATTAGACCTAGGCCTCAGCTGCACTGCC | SEQ ID NO: 1073 |
| | | RPr | GGTCTGCCCAAATGCTTTTC | SEQ ID NO: 1074 |
| HSPA8 | NM_006597.3 | FPr | CCTCCCTCTGGTGGTGCTT | SEQ ID NO: 1075 |
| | | Probe | CTCAGGGCCCACCATTGAAGAGGTTG | SEQ ID NO: 1076 |
| | | RPr | GCTACATCTACACTTGGTTGGCTTAA | SEQ ID NO: 1077 |
| HSPB1 | NM_001540.2 | FPr | CCGACTGGAGGAGCATAAA | SEQ ID NO: 1078 |
| | | Probe | CGCACTTTTCTGAGCAGACGTCCA | SEQ ID NO: 1079 |
| | | RPr | ATGCTGGCTGACTCTGCTC | SEQ ID NO: 1080 |
| HSPCA | NM_005348.2 | FPr | CAAAAGGCAGAGGCTGATAA | SEQ ID NO: 1081 |
| | | Probe | TGACCAGATCCTTCACAGACTTGTCGT | SEQ ID NO: 1082 |
| | | RPr | AGCGCAGTTTCATAAAGCAA | SEQ ID NO: 1083 |

TABLE A-continued

| Gene | Accession | Reagt | Sequence | SEQ ID NO |
|---|---|---|---|---|
| HSPE1 | NM_002157.1 | FPr | GCAAGCAACAGTAGTCGCTG | SEQ ID NO: 1084 |
| | | Probe | TCTCCACCCTTTCCTTTAGAACCCG | SEQ ID NO: 1085 |
| | | RPr | CCAACTTTCACGCTAACTGGT | SEQ ID NO: 1086 |
| HSPG2 | NM_005529.2 | FPr | GAGTACGTGTGCCGAGTGTT | SEQ ID NO: 1087 |
| | | Probe | CAGCTCCGTGCCTCTAGAGGCCT | SEQ ID NO: 1088 |
| | | RPr | CTCAATGGTGACCAGGACA | SEQ ID NO: 1089 |
| ICAM1 | NM_000201.1 | FPr | GCAGACAGTGACCATCTACAGCTT | SEQ ID NO: 1090 |
| | | Probe | CCGGCGCCCAACGTGATTCT | SEQ ID NO: 1091 |
| | | RPr | CTTCTGAGACCTCTGGCTTCGT | SEQ ID NO: 1092 |
| ICAM2 | NM_000873.2 | FPr | GGTCATCCTGACACTGCAAC | SEQ ID NO: 1093 |
| | | Probe | TTGCCCACAGCCACCAAAGTG | SEQ ID NO: 1094 |
| | | RPr | TGCACTCAATGGTGAAGGAC | SEQ ID NO: 1095 |
| ID1 | NM_002165.1 | FPr | AGAACCGCAAGGTGAGCAA | SEQ ID NO: 1096 |
| | | Probe | TGGAGATTCTCCAGCACGTCATCGAC | SEQ ID NO: 1097 |
| | | RPr | TCCAACTGAAGGTCCCTGATG | SEQ ID NO: 1098 |
| ID2 | NM_002166.1 | FPr | AACGACTGCTACTCCAAGCTCAA | SEQ ID NO: 1099 |
| | | Probe | TGCCCAGCATCCCCCAGAACAA | SEQ ID NO: 1100 |
| | | RPr | GGATTTCCATCTTGCTCACCTT | SEQ ID NO: 1101 |
| ID3 | NM_002167.2 | FPr | CTTCACCAAATCCCTTCCTG | SEQ ID NO: 1102 |
| | | Probe | TCACAGTCCTTCGCTCCTGAGCAC | SEQ ID NO: 1103 |
| | | RPr | CTCTGGCTCTTCAGGCTACA | SEQ ID NO: 1104 |
| ID4 | NM_001546.2 | FPr | TGGCCTGGCTCTTAATTTG | SEQ ID NO: 1105 |
| | | Probe | CTTTTGTTTTGCCCAGTATAGACTCGGAAG | SEQ ID NO: 1106 |
| | | RPr | TGCAATCATGCAAGACCAC | SEQ ID NO: 1107 |
| IFIT1 | NM_001548.1 | FPr | TGACAACCAAGCAAATGTGA | SEQ ID NO: 1108 |
| | | Probe | AAGTTGCCCCAGGTCACCAGACTC | SEQ ID NO: 1109 |
| | | RPr | CAGTCTGCCCATGTGGTAAT | SEQ ID NO: 1110 |
| IGF1 | NM_000618.1 | FPr | TCCGGAGCTGTGATCTAAGGA | SEQ ID NO: 1111 |
| | | Probe | TGTATTGCGCACCCCTCAAGCCTG | SEQ ID NO: 1112 |
| | | RPr | CGGACAGAGCGAGCTGACTT | SEQ ID NO: 1113 |
| IGF1R | NM_000875.2 | FPr | GCATGGTAGCCGAAGATTTCA | SEQ ID NO: 1114 |
| | | Probe | CGCGTCATACCAAAATCTCCGATTTTGA | SEQ ID NO: 1115 |
| | | RPr | TTTCCGGTAATAGTCTGTCTCATAGATATC | SEQ ID NO: 1116 |
| IGF2 | NM_000612.2 | FPr | CCGTGCTTCCGGACAACTT | SEQ ID NO: 1117 |
| | | Probe | TACCCCGTGGGCAAGTTCTTCCAA | SEQ ID NO: 1118 |
| | | RPr | TGGACTGCTTCCAGGTGTCA | SEQ ID NO: 1119 |
| IGFBP2 | NM_000597.1 | FPr | GTGGACAGCACCATGAACA | SEQ ID NO: 1120 |
| | | Probe | CTTCCGGCCAGCACTGCCTC | SEQ ID NO: 1121 |
| | | RPr | CCTTCATACCCGACTTGAGG | SEQ ID NO: 1122 |
| IGFBP3 | NM_000598.1 | FPr | ACGCACCGGGTGTCTGA | SEQ ID NO: 1123 |
| | | Probe | CCCAAGTTCCACCCCCTCCATTCA | SEQ ID NO: 1124 |
| | | RPr | TGCCCTTTCTTGATGATGATTATC | SEQ ID NO: 1125 |
| IGFBP5 | NM_000599.1 | FPr | TGGACAAGTACGGGATGAAGCT | SEQ ID NO: 1126 |
| | | Probe | CCCGTCAACGTACTCCATGCCTGG | SEQ ID NO: 1127 |
| | | RPr | CGAAGGTGTGGCACTGAAAGT | SEQ ID NO: 1128 |
| IGFBP6 | NM_002178.1 | FPr | TGAACCGCAGAGACCAACAG | SEQ ID NO: 1129 |
| | | Probe | ATCCAGGCACCTCTACCACGCCCTC | SEQ ID NO: 1130 |
| | | RPr | GTCTTGGACACCCGCAGAAT | SEQ ID NO: 1131 |
| IGFBP7 | NM_001553 | FPr | GGGTCACTATGGAGTTCAAAGGA | SEQ ID NO: 1132 |
| | | Probe | CCCGGTCACCAGGCAGGAGTTCT | SEQ ID NO: 1133 |
| | | RPr | GGGTCTGAATGGCCAGGTT | SEQ ID NO: 1134 |
| IHH | NM_002181.1 | FPr | AAGGACGAGGAGAACACAGG | SEQ ID NO: 1135 |
| | | Probe | ATGACCCAGCGCTGCAAGGAC | SEQ ID NO: 1136 |
| | | RPr | AGATAGCCAGCGAGTTCAGG | SEQ ID NO: 1137 |
| IL-8 | NM_000584.2 | FPr | AAGGAACCATCTCACTGTGTGTAAAC | SEQ ID NO: 1138 |
| | | Probe | TGACTTCCAAGCTGGCCGTGGC | SEQ ID NO: 1139 |
| | | RPr | ATCAGGAAGGCTGCCAAGAG | SEQ ID NO: 1140 |

TABLE A-continued

| Gene | Accession | Reagt | Sequence | SEQ ID NO |
|---|---|---|---|---|
| IL10 | NM_000572.1 | FPr | GGCGCTGTCATCGATTTCTT | SEQ ID NO: 1141 |
| | | Probe | CTGCTCCACGGCCTTGCTCTTG | SEQ ID NO: 1142 |
| | | RPr | TGGAGCTTATTAAAGGCATTCTTCA | SEQ ID NO: 1143 |
| IL1B | NM_000576.2 | FPr | AGCTGAGGAAGATGCTGGTT | SEQ ID NO: 1144 |
| | | Probe | TGCCCACAGACCTTCCAGGAGAAT | SEQ ID NO: 1145 |
| | | RPr | GGAAAGAAGGTGCTCAGGTC | SEQ ID NO: 1146 |
| IL6 | NM_000600.1 | FPr | CCTGAACCTTCCAAAGATGG | SEQ ID NO: 1147 |
| | | Probe | CCAGATTGGAAGCATCCATCTTTTTCA | SEQ ID NO: 1148 |
| | | RPr | ACCAGGCAAGTCTCCTCATT | SEQ ID NO: 1149 |
| IL6ST | NM_002184.2 | FPr | GGCCTAATGTTCCAGATCCT | SEQ ID NO: 1150 |
| | | Probe | CATATTGCCCAGTGGTCACCTCACA | SEQ ID NO: 1151 |
| | | RPr | AAAATTGTGCCTTGGAGGAG | SEQ ID NO: 1152 |
| ILT-2 | NM_006669.1 | FPr | AGCCATCACTCTCAGTGCAG | SEQ ID NO: 1153 |
| | | Probe | CAGGTCCTATCGTGGCCCTGA | SEQ ID NO: 1154 |
| | | RPr | ACTGCAGAGTCAGGGTCTCC | SEQ ID NO: 1155 |
| IMP-1 | NM_006546.2 | FPr | GAAAGTGTTTGCGGAGCAC | SEQ ID NO: 1156 |
| | | Probe | CTCCTACAGCGGCCAGTTCTTGGT | SEQ ID NO: 1157 |
| | | RPr | GAAGGCGTAGCCGGATTT | SEQ ID NO: 1158 |
| IMP2 | NM_006548.3 | FPr | CAATCTGATCCCAGGGTTGAA | SEQ ID NO: 1159 |
| | | Probe | CTCAGCGCACTTGGCATCTTTTCAACA | SEQ ID NO: 1160 |
| | | RPr | GGCCCTGCTGGTGAGATA | SEQ ID NO: 1161 |
| ING1L | NM_001564.1 | FPr | TGTTTCCAAGATCCTGCTGA | SEQ ID NO: 1162 |
| | | Probe | CCATCTTTGCTTTATCTGAGGCTCGTTC | SEQ ID NO: 1163 |
| | | RPr | TCTTTCTGGTTGGCTGGAAT | SEQ ID NO: 1164 |
| ING5 | NM_032329.4 | FPr | CCTACAGCAAGTGCAAGGAA | SEQ ID NO: 1165 |
| | | Probe | CCAGCTGCACTTTGTCGTCACTGT | SEQ ID NO: 1166 |
| | | RPr | CATCTCGTAGGTCTGCATGG | SEQ ID NO: 1167 |
| INHA | NM_002191.2 | FPr | CCTCCCAGTTTCATCTTCCACTA | SEQ ID NO: 1168 |
| | | Probe | ATGTGCAGCCCACAACCACCATGA | SEQ ID NO: 1169 |
| | | RPr | AGGGACTGGAAGGGACAGGTT | SEQ ID NO: 1170 |
| INHBA | NM_002192.1 | FPr | GTGCCCGAGCCATATAGCA | SEQ ID NO: 1171 |
| | | Probe | ACGTCCGGGTCCTCACTGTCCTTCC | SEQ ID NO: 1172 |
| | | RPr | CGGTAGTGGTTGATGACTGTTGA | SEQ ID NO: 1173 |
| INHBB | NM_002193.1 | FPr | AGCCTCCAGGATACCAGCAA | SEQ ID NO: 1174 |
| | | Probe | AGCTAAGCTGCCATTTGTCACCG | SEQ ID NO: 1175 |
| | | RPr | TCTCCGACTGACAGGCATTTG | SEQ ID NO: 1176 |
| IRS1 | NM_005544.1 | FPr | CCACAGCTCACCTTCTGTCA | SEQ ID NO: 1177 |
| | | Probe | TCCATCCCAGCTCCAGCCAG | SEQ ID NO: 1178 |
| | | RPr | CCTCAGTGCCAGTCTCTTCC | SEQ ID NO: 1179 |
| ITGA3 | NM_002204.1 | FPr | CCATGATCCTCACTCTGCTG | SEQ ID NO: 1180 |
| | | Probe | CACTCCAGACCTCGCTTAGCATGG | SEQ ID NO: 1181 |
| | | RPr | GAAGCTTTGTAGCCGGTGAT | SEQ ID NO: 1182 |
| ITGA4 | NM_000885.2 | FPr | CAACGCTTCAGTGATCAATCC | SEQ ID NO: 1183 |
| | | Probe | CGATCCTGCATCTGTAAATCGCCC | SEQ ID NO: 1184 |
| | | RPr | GTCTGGCCGGGATTCTTT | SEQ ID NO: 1185 |
| ITGA5 | NM_002205.1 | FPr | AGGCCAGCCCTACATTATCA | SEQ ID NO: 1186 |
| | | Probe | TCTGAGCCTTGTCCTCTATCCGGC | SEQ ID NO: 1187 |
| | | RPr | GTCTTCTCCACAGTCCAGCA | SEQ ID NO: 1188 |
| ITGA6 | NM_000210.1 | FPr | CAGTGACAAACAGCCCTTCC | SEQ ID NO: 1189 |
| | | Probe | TCGCCATCTTTTGTGGGATTCCTT | SEQ ID NO: 1190 |
| | | RPr | GTTTAGCCTCATGGGCGTC | SEQ ID NO: 1191 |
| ITGA7 | NM_002206.1 | FPr | GATATGATTGGTCGCTGCTTTG | SEQ ID NO: 1192 |
| | | Probe | CAGCCAGGACCTGGCCATCCG | SEQ ID NO: 1193 |
| | | RPr | AGAACTTCCATTCCCCACCAT | SEQ ID NO: 1194 |
| ITGAV | NM_002210.2 | FPr | ACTCGGACTGCACAAGCTATT | SEQ ID NO: 1195 |
| | | Probe | CCGACAGCCACAGAATAACCCAAA | SEQ ID NO: 1196 |
| | | RPr | TGCCATCACCATTGAAATCT | SEQ ID NO: 1197 |

TABLE A-continued

| Gene | Accession | Reagt | Sequence | SEQ ID NO |
|---|---|---|---|---|
| ITGB1 | NM_002211.2 | FPr | TCAGAATTGGATTTGGCTCA | SEQ ID NO: 1198 |
| | | Probe | TGCTAATGTAAGGCATCACAGTCTTTTCCA | SEQ ID NO: 1199 |
| | | RPr | CCTGAGCTTAGCTGGTGTTG | SEQ ID NO: 1200 |
| ITGB3 | NM_000212.1 | FPr | ACCGGGAGCCCTACATGAC | SEQ ID NO: 1201 |
| | | Probe | AAATACCTGCAACCGTTACTGCCGTGAC | SEQ ID NO: 1202 |
| | | RPr | CCTTAAGCTCTTTCACTGACTCAATCT | SEQ ID NO: 1203 |
| ITGB4 | NM_000213.2 | FPr | CAAGGTGCCCTCAGTGGA | SEQ ID NO: 1204 |
| | | Probe | CACCAACCTGTACCCGTATTGCGA | SEQ ID NO: 1205 |
| | | RPr | GCGCACACCTTCATCTCAT | SEQ ID NO: 1206 |
| ITGB5 | NM_002213.3 | FPr | TCGTGAAAGATGACCAGGAG | SEQ ID NO: 1207 |
| | | Probe | TGCTATGTTTCTACAAAACCGCCAAGG | SEQ ID NO: 1208 |
| | | RPr | GGTGAACATCATGACGCAGT | SEQ ID NO: 1209 |
| K-ras | NM_033360.2 | FPr | GTCAAAATGGGGAGGGACTA | SEQ ID NO: 1210 |
| | | Probe | TGTATCTTGTTGAGCTATCCAAACTGCCC | SEQ ID NO: 1211 |
| | | RPr | CAGGACCACCACAGAGTGAG | SEQ ID NO: 1212 |
| KCNH2 iso a/b | NM_000238.2 | FPr | GAGCGCAAAGTGGAAATCG | SEQ ID NO: 1213 |
| | | Probe | TAGGAAGCAGCTCCCATCTTTCCGGTA | SEQ ID NO: 1214 |
| | | RPr | TCTTCACGGGCACCACATC | SEQ ID NO: 1215 |
| KCNH2 iso a/c | NM_172057.1 | FPr | TCCTGCTGCTGGTCATCTAC | SEQ ID NO: 1216 |
| | | Probe | TGTCTTCACACCCTACTCGGCTGC | SEQ ID NO: 1217 |
| | | RPr | CCTTCTTCCGTCTCCTTCAG | SEQ ID NO: 1218 |
| KCNK4 | NM_016611.2 | FPr | CCTATCAGCCGCTGGTGT | SEQ ID NO: 1219 |
| | | Probe | ATCCTGCTCGGCCTGGCTTACTTC | SEQ ID NO: 1220 |
| | | RPr | TGGTGGTGAGCACTGAGG | SEQ ID NO: 1221 |
| KDR | NM_002253.1 | FPr | GAGGACGAAGGCCTCTACAC | SEQ ID NO: 1222 |
| | | Probe | CAGGCATGCAGTGTTCTTGGCTGT | SEQ ID NO: 1223 |
| | | RPr | AAAAATGCCTCCACTTTTGC | SEQ ID NO: 1224 |
| Ki-67 | NM_002417.1 | FPr | CGGACTTTGGGTGCGACTT | SEQ ID NO: 1225 |
| | | Probe | CCACTTGTCGAACCACCGCTCGT | SEQ ID NO: 1226 |
| | | RPr | TTACAACTCTTCCACTGGGACGAT | SEQ ID NO: 1227 |
| KIAA0125 | NM_014792.2 | FPr | GTGTCCTGGTCCATGTGGT | SEQ ID NO: 1228 |
| | | Probe | CACGTGTCTCCACCTCCAAGGAGA | SEQ ID NO: 1229 |
| | | RPr | GGGAGGTGCACACTGAGG | SEQ ID NO: 1230 |
| KIF22 | NM_007317.1 | FPr | CTAAGGCACTTGCTGGAAGG | SEQ ID NO: 1231 |
| | | Probe | TCCATAGGCAAGCACACTGGCATT | SEQ ID NO: 1232 |
| | | RPr | TCTTCCCAGCTCCTGTGG | SEQ ID NO: 1233 |
| KIF2C | NM_006845.2 | FPr | AATTCCTGCTCCAAAAGAAAGTCTT | SEQ ID NO: 1234 |
| | | Probe | AAGCCGCTCCACTCGCATGTCC | SEQ ID NO: 1235 |
| | | RPr | CGTGATGCGAAGCTCTGAGA | SEQ ID NO: 1236 |
| KIFC1 | XM_371813.1 | FPr | CCACAGGGTTGAAGAACCAG | SEQ ID NO: 1237 |
| | | Probe | AGCCAGTTCCTGCTGTTCCTGTCC | SEQ ID NO: 1238 |
| | | RPr | CACCTGATGTGCCAGACTTC | SEQ ID NO: 1239 |
| Kitlng | NM_000899.1 | FPr | GTCCCCGGGATGGATGTT | SEQ ID NO: 1240 |
| | | Probe | CATCTCGCTTATCCAACAATGACTTGGCA | SEQ ID NO: 1241 |
| | | RPr | GATCAGTCAAGCTGTCTGACAATTG | SEQ ID NO: 1242 |
| KLF5 | NM_001730.3 | FPr | GTGCAACCGCAGCTTCTC | SEQ ID NO: 1243 |
| | | Probe | CTCTGACCACCTGGCCCTGCATAT | SEQ ID NO: 1244 |
| | | RPr | CGGGCAGTGCTCAGTTCT | SEQ ID NO: 1245 |
| KLF6 | NM_001300.4 | FPr | CACGAGACCGGCTACTTCTC | SEQ ID NO: 1246 |
| | | Probe | AGTACTCCTCCAGAGACGGCAGCG | SEQ ID NO: 1247 |
| | | RPr | GCTCTAGGCAGGTCTGTTGC | SEQ ID NO: 1248 |
| KLK10 | NM_002776.1 | FPr | GCCCAGAGGCTCCATCGT | SEQ ID NO: 1249 |
| | | Probe | CCTCTTCCTCCCCAGTCGGCTGA | SEQ ID NO: 1250 |
| | | RPr | CAGAGGTTTGAACAGTGCAGACA | SEQ ID NO: 1251 |
| KLK6 | NM_002774.2 | FPr | GACGTGAGGGTCCTGATTCT | SEQ ID NO: 1252 |
| | | Probe | TTACCCCAGCTCCATCCTTGCATC | SEQ ID NO: 1253 |
| | | RPr | TCCTCACTCATCACGTCCTC | SEQ ID NO: 1254 |

TABLE A-continued

| Gene | Accession | Reagt | Sequence | SEQ ID NO |
|---|---|---|---|---|
| KLRK1 | NM_007360.1 | FPr | TGAGAGCCAGGCTTCTTGTA | SEQ ID NO: 1255 |
| | | Probe | TGTCTCAAAATGCCAGCCTTCTGAA | SEQ ID NO: 1256 |
| | | RPr | ATCCTGGTCCTCTTTGCTGT | SEQ ID NO: 1257 |
| KNTC2 | NM_006101.1 | FPr | ATGTGCCAGTGAGCTTGAGT | SEQ ID NO: 1258 |
| | | Probe | CCTTGGAGAAACACAAGCACCTGC | SEQ ID NO: 1259 |
| | | RPr | TGAGCCCCTGGTTAACAGTA | SEQ ID NO: 1260 |
| KRAS2 | NM_004985.3 | FPr | GAGACCAAGGTTGCAAGGC | SEQ ID NO: 1261 |
| | | Probe | AAGCTCAAAGGTTCACACAGGGCC | SEQ ID NO: 1262 |
| | | RPr | CAGTCCATGCTGTGAAACTCTC | SEQ ID NO: 1263 |
| KRT19 | NM_002276.1 | FPr | TGAGCGGCAGAATCAGGAGTA | SEQ ID NO: 1264 |
| | | Probe | CTCATGGACATCAAGTCGCGGCTG | SEQ ID NO: 1265 |
| | | RPr | TGCGGTAGGTGGCAATCTC | SEQ ID NO: 1266 |
| KRT8 | NM_002273.1 | FPr | GGATGAAGCTTACATGAACAAGGTAGA | SEQ ID NO: 1267 |
| | | Probe | CGTCGGTCAGCCCTTCCAGGC | SEQ ID NO: 1268 |
| | | RPr | CATATAGCTGCCTGAGGAAGTTGAT | SEQ ID NO: 1269 |
| LAMA3 | NM_000227.2 | FPr | CAGATGAGGCACATGGAGAC | SEQ ID NO: 1270 |
| | | Probe | CTGATTCCTCAGGTCCTTGGCCTG | SEQ ID NO: 1271 |
| | | RPr | TTGAAATGGCAGAACGGTAG | SEQ ID NO: 1272 |
| LAMB3 | NM_000228.1 | FPr | ACTGACCAAGCCTGAGACCT | SEQ ID NO: 1273 |
| | | Probe | CCACTCGCCATACTGGGTGCAGT | SEQ ID NO: 1274 |
| | | RPr | GTCACACTTGCAGCATTTCA | SEQ ID NO: 1275 |
| LAMC2 | NM_005562.1 | FPr | ACTCAAGCGGAAATTGAAGCA | SEQ ID NO: 1276 |
| | | Probe | AGGTCTTATCAGCACAGTCTCCGCCTCC | SEQ ID NO: 1277 |
| | | RPr | ACTCCCTGAAGCCGAGACACT | SEQ ID NO: 1278 |
| LAT | NM_014387.2 | FPr | GTGAACGTTCCGGAGAGC | SEQ ID NO: 1279 |
| | | Probe | ATCCAGAGACGCTTCTGCGCTCTC | SEQ ID NO: 1280 |
| | | RPr | ACATTCACATACTCCCGGCT | SEQ ID NO: 1281 |
| LCN2 | NM_005564.2 | FPr | CGCTGGGCAACATTAAGAG | SEQ ID NO: 1282 |
| | | Probe | TCACCACTCGGACGAGGTAACTCG | SEQ ID NO: 1283 |
| | | RPr | AGCATGCTGGTTGTAGTTGGT | SEQ ID NO: 1284 |
| LDLRAP1 | NM_015627.1 | FPr | CAGTGCCTCTCGCCTGTC | SEQ ID NO: 1285 |
| | | Probe | ACTGGGACAAGCCTGACAGCAGC | SEQ ID NO: 1286 |
| | | RPr | TGAAGAGGTCATCCTGCTCTG | SEQ ID NO: 1287 |
| LEF | NM_016269.2 | FPr | GATGACGGAAAGCATCCAG | SEQ ID NO: 1288 |
| | | Probe | TGGAGGCCTCTACAACAAGGGACC | SEQ ID NO: 1289 |
| | | RPr | CCCGGAATAACTCGAGTAGGA | SEQ ID NO: 1290 |
| LGALS3 | NM_002306.1 | FPr | AGCGGAAAATGGCAGACAAT | SEQ ID NO: 1291 |
| | | Probe | ACCCAGATAACGCATCATGGAGCGA | SEQ ID NO: 1292 |
| | | RPr | CTTGAGGGTTTGGGTTTCCA | SEQ ID NO: 1293 |
| LGMN | NM_001008530.1 | FPr | TTGGTGCCGTTCCTATAGATG | SEQ ID NO: 1294 |
| | | Probe | CAGTGCTTGCCTCCATCTTCAGGA | SEQ ID NO: 1295 |
| | | RPr | GAACCTGCCACGATCACC | SEQ ID NO: 1296 |
| LILRB3 | NM_006864.1 | FPr | CACCTGGTCTGGGAAGATACC | SEQ ID NO: 1297 |
| | | Probe | ACCGAGACCCCAATCAAAACCTCC | SEQ ID NO: 1298 |
| | | RPr | AAGAGCAGCAGGACGAAGG | SEQ ID NO: 1299 |
| LMNB1 | NM_005573.1 | FPr | TGCAAACGCTGGTGTCACA | SEQ ID NO: 1300 |
| | | Probe | CAGCCCCCAACTGACCTCATC | SEQ ID NO: 1301 |
| | | RPr | CCCCACGAGTTCTGGTTCTTC | SEQ ID NO: 1302 |
| LMYC | NM_012421.1 | FPr | CCCATCCAGAACACTGATTG | SEQ ID NO: 1303 |
| | | Probe | TGACCTCCATCCCTTTCACTTGAATG | SEQ ID NO: 1304 |
| | | RPr | CTGCTTTCTATGCACCCTTTC | SEQ ID NO: 1305 |
| LOX | NM_002317.3 | FPr | CCAATGGGAGAACAACGG | SEQ ID NO: 1306 |
| | | Probe | CAGGCTCAGCAAGCTGAACACCTG | SEQ ID NO: 1307 |
| | | RPr | CGCTGAGGCTGGTACTGTG | SEQ ID NO: 1308 |
| LOXL2 | NM_002318.1 | FPr | TCAGCGGGCTCTTAAACAA | SEQ ID NO: 1309 |
| | | Probe | CAGCTGTCCCCGCAGTAAAGAAGC | SEQ ID NO: 1310 |
| | | RPr | AAGACAGGAGTTGACCACGC | SEQ ID NO: 1311 |

TABLE A-continued

| Gene | Accession | Reagt | Sequence | SEQ ID NO |
|---|---|---|---|---|
| LRP5 | NM_002335.1 | FPr | CGACTATGACCCACTGGACA | SEQ ID NO: 1312 |
| | | Probe | CGCCCATCCACCCAGTAGATGAAC | SEQ ID NO: 1313 |
| | | RPr | CTTGGCTCGCTTGATGTTC | SEQ ID NO: 1314 |
| LRP6 | NM_002336.1 | FPr | GGATGTAGCCATCTCTGCCT | SEQ ID NO: 1315 |
| | | Probe | ATAGACCTCAGGGCCTTCGCTGTG | SEQ ID NO: 1316 |
| | | RPr | AGTTCAAAGCCAATAGGGCA | SEQ ID NO: 1317 |
| LY6D | NM_003695.2 | FPr | AATGCTGATGACTTGGAGCAG | SEQ ID NO: 1318 |
| | | Probe | CACAGACCCCACAGAGGATGAAGC | SEQ ID NO: 1319 |
| | | RPr | CTGCATCCTCTGTGGGGT | SEQ ID NO: 1320 |
| MAD | NM_002357.1 | FPr | TGGTTCTGATTAGGTAACGTATTGGA | SEQ ID NO: 1321 |
| | | Probe | CTGCCCACAACTCCCTTGCACGTAA | SEQ ID NO: 1322 |
| | | RPr | GGTCAAGGTGGGACACTGAAG | SEQ ID NO: 1323 |
| MAD1L1 | NM_003550.1 | FPr | AGAAGCTGTCCCTGCAAGAG | SEQ ID NO: 1324 |
| | | Probe | CATGTTCTTCACAATCGCTGCATCC | SEQ ID NO: 1325 |
| | | RPr | AGCCGTACCAGCTCAGACTT | SEQ ID NO: 1326 |
| MAD2L1 | NM_002358.2 | FPr | CCGGGAGCAGGGAATCAC | SEQ ID NO: 1327 |
| | | Probe | CGGCCACGATTTCGGCGCT | SEQ ID NO: 1328 |
| | | RPr | ATGCTGTTGATGCCGAATGA | SEQ ID NO: 1329 |
| MADH2 | NM_005901.2 | FPr | GCTGCCTTTGGTAAGAACATGTC | SEQ ID NO: 1330 |
| | | Probe | TCCATCTTGCCATTCACGCCGC | SEQ ID NO: 1331 |
| | | RPr | ATCCCAGCAGTCTCTTCACAACT | SEQ ID NO: 1332 |
| MADH4 | NM_005359.3 | FPr | GGACATTACTGGCCTGTTCACA | SEQ ID NO: 1333 |
| | | Probe | TGCATTCCAGCCTCCCATTTCCA | SEQ ID NO: 1334 |
| | | RPr | ACCAATACTCAGGAGCAGGATGA | SEQ ID NO: 1335 |
| MADH7 | NM_005904.1 | FPr | TCCATCAAGGCTTTCGACTA | SEQ ID NO: 1336 |
| | | Probe | CTGCAGGCTGTACGCCTTCTCG | SEQ ID NO: 1337 |
| | | RPr | CTGCTGCATAAACTCGTGGT | SEQ ID NO: 1338 |
| MAP2 | NM_031846.1 | FPr | CGGACCACCAGGTCAGAG | SEQ ID NO: 1339 |
| | | Probe | CCACTCTTCCCTGCTCTGCGAATT | SEQ ID NO: 1340 |
| | | RPr | CAGGGGTAGTGGGTGTTGAG | SEQ ID NO: 1341 |
| MAP2K1 | NM_002755.2 | FPr | GCCTTTCTTACCCAGAAGCAGAA | SEQ ID NO: 1342 |
| | | Probe | TCTCAAAGTCGTCATCCTTCAGTTCTCCCA | SEQ ID NO: 1343 |
| | | RPr | CAGCCCCCAGCTCACTGAT | SEQ ID NO: 1344 |
| MAP3K1 | XM_042066.8 | FPr | GGTTGGCATCAAAAGGAACT | SEQ ID NO: 1345 |
| | | Probe | AATTGTCCCTGAAACTCTCCTGCACC | SEQ ID NO: 1346 |
| | | RPr | TGCCATAAATGCAATTGTCC | SEQ ID NO: 1347 |
| MAPK14 | NM_139012.1 | FPr | TGAGTGGAAAAGCCTGACCTATG | SEQ ID NO: 1348 |
| | | Probe | TGAAGTCATCAGCTTTGTGCCACCACC | SEQ ID NO: 1349 |
| | | RPr | GGACTCCATCTCTTCTTGGTCAA | SEQ ID NO: 1350 |
| Maspin | NM_002639.1 | FPr | CAGATGGCCACTTTGAGAACATT | SEQ ID NO: 1351 |
| | | Probe | AGCTGACAACAGTGTGAACGACCAGCC | SEQ ID NO: 1352 |
| | | RPr | GGCAGCATTAACCACAAGGATT | SEQ ID NO: 1353 |
| MAX | NM_002382.3 | FPr | CAAACGGGCTCATCATAATGC | SEQ ID NO: 1354 |
| | | Probe | TGATGTGGTCCCTACGTTTTCGTTCCA | SEQ ID NO: 1355 |
| | | RPr | TCCCGCAAACTGTGAAAGCT | SEQ ID NO: 1356 |
| MCM2 | NM_004526.1 | FPr | GACTTTTGCCCGCTACCTTTC | SEQ ID NO: 1357 |
| | | Probe | ACAGCTCATTGTTGTCACGCCGGA | SEQ ID NO: 1358 |
| | | RPr | GCCACTAACTGCTTCAGTATGAAGAG | SEQ ID NO: 1359 |
| MCM3 | NM_002388.2 | FPr | GGAGAACAATCCCCTTGAGA | SEQ ID NO: 1360 |
| | | Probe | TGGCCTTTCTGTCTACAAGGATCACCA | SEQ ID NO: 1361 |
| | | RPr | ATCTCCTGGATGGTGATGGT | SEQ ID NO: 1362 |
| MCM6 | NM_005915.2 | FPr | TGATGGTCCTATGTGTCACATTCA | SEQ ID NO: 1363 |
| | | Probe | CAGGTTTCATACCAACACAGGCTTCAGCAC | SEQ ID NO: 1364 |
| | | RPr | TGGGACAGGAAACACACCAA | SEQ ID NO: 1365 |
| MCP1 | NM_002982.1 | FPr | CGCTCAGCCAGATGCAATC | SEQ ID NO: 1366 |
| | | Probe | TGCCCCAGTCACCTGCTGTTA | SEQ ID NO: 1367 |
| | | RPr | GCACTGAGATCTTCCTATTGGTGAA | SEQ ID NO: 1368 |

TABLE A-continued

| Gene | Accession | Reagt | Sequence | SEQ ID NO |
|---|---|---|---|---|
| MDK | NM_002391.2 | FPr | GGAGCCGACTGCAAGTACA | SEQ ID NO: 1369 |
| | | Probe | ATCACACGCACCCCAGTTCTCAAA | SEQ ID NO: 1370 |
| | | RPr | GACTTTGGTGCCTGTGCC | SEQ ID NO: 1371 |
| MDM2 | NM_002392.1 | FPr | CTACAGGGACGCCATCGAA | SEQ ID NO: 1372 |
| | | Probe | CTTACACCAGCATCAAGATCCGG | SEQ ID NO: 1373 |
| | | RPr | ATCCAACCAATCACCTGAATGTT | SEQ ID NO: 1374 |
| MGAT5 | NM_002410.2 | FPr | GGAGTCGAAGGTGGACAATC | SEQ ID NO: 1375 |
| | | Probe | AATGGCACCGGAACAAACTCAACC | SEQ ID NO: 1376 |
| | | RPr | TGGGAACAGCTGTAGTGGAGT | SEQ ID NO: 1377 |
| MGMT | NM_002412.1 | FPr | GTGAAATGAAACGCACCACA | SEQ ID NO: 1378 |
| | | Probe | CAGCCCTTTGGGGAAGCTGG | SEQ ID NO: 1379 |
| | | RPr | GACCCTGCTCACAACCAGAC | SEQ ID NO: 1380 |
| mGST1 | NM_020300.2 | FPr | ACGGATCTACCACACCATTGC | SEQ ID NO: 1381 |
| | | Probe | TTTGACACCCCTTCCCCAGCCA | SEQ ID NO: 1382 |
| | | RPr | TCCATATCCAACAAAAAAACTCAAAG | SEQ ID NO: 1383 |
| MMP1 | NM_002421.2 | FPr | GGGAGATCATCGGGACAACTC | SEQ ID NO: 1384 |
| | | Probe | AGCAAGATTTCCTCCAGGTCCATCAAAAGG | SEQ ID NO: 1385 |
| | | RPr | GGGCCTGGTTGAAAAGCAT | SEQ ID NO: 1386 |
| MMP12 | NM_002426.1 | FPr | CCAACGCTTGCCAAATCCT | SEQ ID NO: 1387 |
| | | Probe | AACCAGCTCTCTGTGACCCCAATT | SEQ ID NO: 1388 |
| | | RPr | ACGGTAGTGACAGCATCAAAACTC | SEQ ID NO: 1389 |
| MMP2 | NM_004530.1 | FPr | CCATGATGGAGAGGCAGACA | SEQ ID NO: 1390 |
| | | Probe | CTGGGAGCATGGCGATGGATACCC | SEQ ID NO: 1391 |
| | | RPr | GGAGTCCGTCCTTACCGTCAA | SEQ ID NO: 1392 |
| MMP7 | NM_002423.2 | FPr | GGATGGTAGCAGTCTAGGGATTAACT | SEQ ID NO: 1393 |
| | | Probe | CCTGTATGCTGCAACTCATGAACTTGGC | SEQ ID NO: 1394 |
| | | RPr | GGAATGTCCCATACCCAAAGAA | SEQ ID NO: 1395 |
| MMP9 | NM_004994.1 | FPr | GAGAACCAATCTCACCGACA | SEQ ID NO: 1396 |
| | | Probe | ACAGGTATTCCTCTGCCAGCTGCC | SEQ ID NO: 1397 |
| | | RPr | CACCCGAGTGTAACCATAGC | SEQ ID NO: 1398 |
| MRP1 | NM_004996.2 | FPr | TCATGGTGCCCGTCAATG | SEQ ID NO: 1399 |
| | | Probe | ACCTGATACGTCTTGGTCTTCATCGCCAT | SEQ ID NO: 1400 |
| | | RPr | CGATTGTCTTTGCTCTTCATGTG | SEQ ID NO: 1401 |
| MRP2 | NM_000392.1 | FPr | AGGGGATGACTTGGACACAT | SEQ ID NO: 1402 |
| | | Probe | CTGCCATTCGACATGACTGCAATTT | SEQ ID NO: 1403 |
| | | RPr | AAAACTGCATGGCTTTGTCA | SEQ ID NO: 1404 |
| MRP3 | NM_003786.2 | FPr | TCATCCTGGCGATCTACTTCCT | SEQ ID NO: 1405 |
| | | Probe | TCTGTCCTGGCTGGAGTCGCTTTCAT | SEQ ID NO: 1406 |
| | | RPr | CCGTTGAGTGGAATCAGCAA | SEQ ID NO: 1407 |
| MRP4 | NM_005845.1 | FPr | AGCGCCTGGAATCTACAACT | SEQ ID NO: 1408 |
| | | Probe | CGGAGTCCAGTGTTTTCCCACTTG | SEQ ID NO: 1409 |
| | | RPr | AGAGCCCCTGGAGAGAAGAT | SEQ ID NO: 1410 |
| MRPL40 | NM_003776.2 | FPr | ACTTGCAGGCTGCTATCCTT | SEQ ID NO: 1411 |
| | | Probe | TTCCTACTCTCAGGGGCAGCATGTT | SEQ ID NO: 1412 |
| | | RPr | AGCAGACTTGAACCCTGGTC | SEQ ID NO: 1413 |
| MSH2 | NM_000251.1 | FPr | GATGCAGAATTGAGGCAGAC | SEQ ID NO: 1414 |
| | | Probe | CAAGAAGATTTACTTCGTCGATTCCCAGA | SEQ ID NO: 1415 |
| | | RPr | TCTTGGCAAGTCGGTTAAGA | SEQ ID NO: 1416 |
| MSH3 | NM_002439.1 | FPr | TGATTACCATCATGGCTCAGA | SEQ ID NO: 1417 |
| | | Probe | TCCCAATTGTCGCTTCTTCTGCAG | SEQ ID NO: 1418 |
| | | RPr | CTTGTGAAAATGCCATCCAC | SEQ ID NO: 1419 |
| MSH6 | NM_000179.1 | FPr | TCTATTGGGGATTGGTAGG | SEQ ID NO: 1420 |
| | | Probe | CCGTTACCAGCTGGAAATTCCTGAGA | SEQ ID NO: 1421 |
| | | RPr | CAAATTGCGAGTGGTGAAAT | SEQ ID NO: 1422 |
| MT3 | NM_005954.1 | FPr | GTGTGAGAAGTGTGCCAAGG | SEQ ID NO: 1423 |
| | | Probe | CTCTCCGCCTTTGCACACACAGT | SEQ ID NO: 1424 |
| | | RPr | CTGCACTTCTCTGCTTCTGC | SEQ ID NO: 1425 |

TABLE A-continued

| Gene | Accession | Reagt | Sequence | SEQ ID NO |
|---|---|---|---|---|
| MTA1 | NM_004689.2 | FPr | CCGCCCTCACCTGAAGAGA | SEQ ID NO: 1426 |
| | | Probe | CCCAGTGTCCGCCAAGGAGCG | SEQ ID NO: 1427 |
| | | RPr | GGAATAAGTTAGCCGCGCTTCT | SEQ ID NO: 1428 |
| MUC1 | NM_002456.1 | FPr | GGCCAGGATCTGTGGTGGTA | SEQ ID NO: 1429 |
| | | Probe | CTCTGGCCTTCCGAGAAGGTACC | SEQ ID NO: 1430 |
| | | RPr | CTCCACGTCGTGGACATTGA | SEQ ID NO: 1431 |
| MUC2 | NM_002457.1 | FPr | CTATGAGCCATGTGGGAACC | SEQ ID NO: 1432 |
| | | Probe | AGCTTCGAGACCTGCAGGACCATC | SEQ ID NO: 1433 |
| | | RPr | ATGTTGGAGTGGATGCCG | SEQ ID NO: 1434 |
| MUC5B | XM_039877.11 | FPr | TGCCCTTGCACTGTCCTAA | SEQ ID NO: 1435 |
| | | Probe | TCAGCCATCCTGCACACCTACACC | SEQ ID NO: 1436 |
| | | RPr | CAGCCACACTCATCCACG | SEQ ID NO: 1437 |
| MUTYH | NM_012222.1 | FPr | GTACGACCAAGAGAAACGGG | SEQ ID NO: 1438 |
| | | Probe | TCTGCCCGTCTTCTCCATGGTAGG | SEQ ID NO: 1439 |
| | | RPr | CCTGTCCAGGTCCATCTCA | SEQ ID NO: 1440 |
| MVP | NM_017458.1 | FPr | ACGAGAACGAGGGCATCTATGT | SEQ ID NO: 1441 |
| | | Probe | CGCACCTTTCCGGTCTTGACATCCT | SEQ ID NO: 1442 |
| | | RPr | GCATGTAGGTGCTTCCAATCAC | SEQ ID NO: 1443 |
| MX1 | NM_002462.2 | FPr | GAAGGAATGGGAATCAGTCATGA | SEQ ID NO: 1444 |
| | | Probe | TCACCCTGGAGATCAGCTCCGA | SEQ ID NO: 1445 |
| | | RPr | GTCTATTAGAGTCAGATCCGGGACAT | SEQ ID NO: 1446 |
| MXD4 | NM_006454.2 | FPr | AGAAACTGGAGGAGCAGGAC | SEQ ID NO: 1447 |
| | | Probe | TGCAGCTGCTCCTTGATGCTCAGT | SEQ ID NO: 1448 |
| | | RPr | CTTCAGGAAACGATGCTCCT | SEQ ID NO: 1449 |
| MYBL2 | NM_002466.1 | FPr | GCCGAGATCGCCAAGATG | SEQ ID NO: 1450 |
| | | Probe | CAGCATTGTCTGTCCTCCCTGGCA | SEQ ID NO: 1451 |
| | | RPr | CTTTTGATGGTAGAGTTCCAGTGATTC | SEQ ID NO: 1452 |
| MYH11 | NM_002474.1 | FPr | CGGTACTTCTCAGGGCTAATATACG | SEQ ID NO: 1453 |
| | | Probe | CTCTTCTGCGTGGTGGTCAACCCCTA | SEQ ID NO: 1454 |
| | | RPr | CCGAGTAGATGGGCAGGTGTT | SEQ ID NO: 1455 |
| MYLK | NM_053025.1 | FPr | TGACGGAGCGTGAGTGCAT | SEQ ID NO: 1456 |
| | | Probe | CCCTCCGAGATCTGCCGCATGTACT | SEQ ID NO: 1457 |
| | | RPr | ATGCCCTGCTTGTGGATGTAC | SEQ ID NO: 1458 |
| NAT2 | NM_000015.1 | FPr | TAACTGACATTCTTGAGCACCAGAT | SEQ ID NO: 1459 |
| | | Probe | CGGGCTGTTCCCTTTGAGAACCTTAACA | SEQ ID NO: 1460 |
| | | RPr | ATGGCTTGCCCACAATGC | SEQ ID NO: 1461 |
| NAV2 | NM_182964.3 | FPr | CTCTCCCAGCACAGCTTGA | SEQ ID NO: 1462 |
| | | Probe | CCTCACTGAGTCAACCAGCCTGGA | SEQ ID NO: 1463 |
| | | RPr | CACCAGTGTCATCCAGCAAC | SEQ ID NO: 1464 |
| NCAM1 | NM_000615.1 | FPr | TAGTTCCCAGCTGACCATCA | SEQ ID NO: 1465 |
| | | Probe | CTCAGCCTCGTCGTTCTTATCCACC | SEQ ID NO: 1466 |
| | | RPr | CAGCCTTGTTCTCAGCAATG | SEQ ID NO: 1467 |
| NDE1 | NM_017668.1 | FPr | CTACTGCGGAAAGTCGGG | SEQ ID NO: 1468 |
| | | Probe | CTGGAGTCCAAACTCGCTTCCTGC | SEQ ID NO: 1469 |
| | | RPr | GGACTGATCGTACACGAGGTT | SEQ ID NO: 1470 |
| NDRG1 | NM_006096.2 | FPr | AGGGCAACATTCCACAGC | SEQ ID NO: 1471 |
| | | Probe | CTGCAAGGACACTCATCACAGCCA | SEQ ID NO: 1472 |
| | | RPr | CAGTGCTCCTACTCCGGC | SEQ ID NO: 1473 |
| NDUFS3 | NM_004551.1 | FPr | TATCCATCCTGATGGCGTC | SEQ ID NO: 1474 |
| | | Probe | CCCAGTGCTGACTTTCCTCAGGGA | SEQ ID NO: 1475 |
| | | RPr | TTGAACTGTGCATTGGTGTG | SEQ ID NO: 1476 |
| NEDD8 | NM_006156.1 | FPr | TGCTGGCTACTGGGTGTTAGT | SEQ ID NO: 1477 |
| | | Probe | TGCAGTCCTGTGTGCTTCCCTCTC | SEQ ID NO: 1478 |
| | | RPr | GACAACCAGGGACACAGTCA | SEQ ID NO: 1479 |
| NEK2 | NM_002497.1 | FPr | GTGAGGCAGCGCGACTCT | SEQ ID NO: 1480 |
| | | Probe | TGCCTTCCCGGGCTGAGGACT | SEQ ID NO: 1481 |
| | | RPr | TGCCAATGGTGTACAACACTTCA | SEQ ID NO: 1482 |

TABLE A-continued

| Gene | Accession | Reagt | Sequence | SEQ ID NO |
|---|---|---|---|---|
| NF2 | NM_000268.2 | FPr | ACTCCAGAGCTGACCTCCAC | SEQ ID NO: 1483 |
| | | Probe | CTACAATGACTTCCCAGGCTGGGC | SEQ ID NO: 1484 |
| | | RPr | TCAGGGCTTCAGTGTCTCAC | SEQ ID NO: 1485 |
| NFKBp50 | NM_003998.1 | FPr | CAGACCAAGGAGATGGACCT | SEQ ID NO: 1486 |
| | | Probe | AAGCTGTAAACATGAGCCGCACCA | SEQ ID NO: 1487 |
| | | RPr | AGCTGCCAGTGCTATCCG | SEQ ID NO: 1488 |
| NFKBp65 | NM_021975.1 | FPr | CTGCCGGGATGGCTTCTAT | SEQ ID NO: 1489 |
| | | Probe | CTGAGCTCTGCCCGGACCGCT | SEQ ID NO: 1490 |
| | | RPr | CCAGGTTCTGGAAACTGTGGAT | SEQ ID NO: 1491 |
| NISCH | NM_007184.1 | FPr | CCAAGGAATCATGTTCGTTCAG | SEQ ID NO: 1492 |
| | | Probe | TGGCCAGCAGCCTCTCGTCCAC | SEQ ID NO: 1493 |
| | | RPr | TGGTGCTCGGGAGTCAGACT | SEQ ID NO: 1494 |
| Nkd-1 | NM_033119.3 | FPr | GAGAGAGTGAGCGAACCCTG | SEQ ID NO: 1495 |
| | | Probe | CCAGGCTCCAAGAAGCAGCTGAAG | SEQ ID NO: 1496 |
| | | RPr | CGTCGCACTGGAGCTCTT | SEQ ID NO: 1497 |
| NMB | NM_021077.1 | FPr | GGCTGCTGGTACAAATACTGC | SEQ ID NO: 1498 |
| | | Probe | TGTCTGCCCCTATTATTGGTGTCATTTCT | SEQ ID NO: 1499 |
| | | RPr | CAATCTAAGCCACGCTGTTG | SEQ ID NO: 1500 |
| NMBR | NM_002511.1 | FPr | TGATCCATCTCTAGGCCACA | SEQ ID NO: 1501 |
| | | Probe | TTGTCACCTTAGTTGCCCGGTTC | SEQ ID NO: 1502 |
| | | RPr | GAGCAAATGGGTTGACACAA | SEQ ID NO: 1503 |
| NME1 | NM_000269.1 | FPr | CCAACCCTGCAGACTCCAA | SEQ ID NO: 1504 |
| | | Probe | CCTGGGACCATCCGTGGAGACTTCT | SEQ ID NO: 1505 |
| | | RPr | ATGTATAATGTTCCTGCCAACTTGTATG | SEQ ID NO: 1506 |
| NOS3 | NM_000603.2 | FPr | ATCTCCGCCTCGCTCATG | SEQ ID NO: 1507 |
| | | Probe | TTCACTCGCTTCGCCATCACCG | SEQ ID NO: 1508 |
| | | RPr | TCGGAGCCATACAGGATTGTC | SEQ ID NO: 1509 |
| NOTCH1 | NM_017617.2 | FPr | CGGGTCCACCAGTTTGAATG | SEQ ID NO: 1510 |
| | | Probe | CCGCTCTGCAGCCGGACA | SEQ ID NO: 1511 |
| | | RPr | GTTGTATTGGTTCGGCACCAT | SEQ ID NO: 1512 |
| NOTCH2 | NM_024408.2 | FPr | CACTTCCCTGCTGGGATTAT | SEQ ID NO: 1513 |
| | | Probe | CCGTGTTGCACAGCTCATCACACT | SEQ ID NO: 1514 |
| | | RPr | AGTTGTCAAACAGGCACTCG | SEQ ID NO: 1515 |
| NPM1 | NM_002520.2 | FPr | AATGTTGTCCAGGTTCTATTGC | SEQ ID NO: 1516 |
| | | Probe | AACAGGCATTTTGGACAACACATTCTTG | SEQ ID NO: 1517 |
| | | RPr | CAAGCAAAGGGTGGAGTTC | SEQ ID NO: 1518 |
| NR4A1 | NM_002135.2 | FPr | CACAGCTTGCTTGTCGATGTC | SEQ ID NO: 1519 |
| | | Probe | CCTTCGCCTGCCTCTCTGCCC | SEQ ID NO: 1520 |
| | | RPr | ATGCCGGTCGGTGATGAG | SEQ ID NO: 1521 |
| NRG1 | NM_013957.1 | FPr | CGAGACTCTCCTCATAGTGAAAGGTAT | SEQ ID NO: 1522 |
| | | Probe | ATGACCACCCCGGCTCGTATGTCA | SEQ ID NO: 1523 |
| | | RPr | CTTGGCGTGTGGAAATCTACAG | SEQ ID NO: 1524 |
| NRP1 | NM_003873.1 | FPr | CAGCTCTCTCCACGCGATTC | SEQ ID NO: 1525 |
| | | Probe | CAGGATCTACCCCGAGAGAGCCACTCAT | SEQ ID NO: 1526 |
| | | RPr | CCCAGCAGCTCCATTCTGA | SEQ ID NO: 1527 |
| NRP2 | NM_003872.1 | FPr | CTACAGCCTAAACGGCAAGG | SEQ ID NO: 1528 |
| | | Probe | AGGACCCCAGGACCCAGCAG | SEQ ID NO: 1529 |
| | | RPr | GTTCCCTTCGAACAGCTTTG | SEQ ID NO: 1530 |
| NTN1 | NM_004822.1 | FPr | AGAAGGACTATGCCGTCCAG | SEQ ID NO: 1531 |
| | | Probe | ATCCACATCCTGAAGGCGGACAAG | SEQ ID NO: 1532 |
| | | RPr | CCGTGAACTTCCACCAGTC | SEQ ID NO: 1533 |
| NUFIP1 | NM_012345.1 | FPr | GCTTCCACATCGTGGTATTG | SEQ ID NO: 1534 |
| | | Probe | CTTCTGATAGGTTTCCTCGGCATCAGA | SEQ ID NO: 1535 |
| | | RPr | AACTGCAGGGTTGAAGGACT | SEQ ID NO: 1536 |
| ODC1 | NM_002539.1 | FPr | AGAGATCACCGGCGTAATCAA | SEQ ID NO: 1537 |
| | | Probe | CCAGCGTTGGACAAATACTTTCCGTCA | SEQ ID NO: 1538 |
| | | RPr | CGGGCTCAGCTATGATTCTCA | SEQ ID NO: 1539 |

TABLE A-continued

| Gene | Accession | Reagt | Sequence | SEQ ID NO |
|---|---|---|---|---|
| OPN, osteopontin | NM_000582.1 | FPr | CAACCGAAGTTTTCACTCCAGTT | SEQ ID NO: 1540 |
| | | Probe | TCCCCACAGTAGACACATATGATGGCCG | SEQ ID NO: 1541 |
| | | RPr | CCTCAGTCCATAAACCACACTATCA | SEQ ID NO: 1542 |
| ORC1L | NM_004153.2 | FPr | TCCTTGACCATACCGGAGG | SEQ ID NO: 1543 |
| | | Probe | TGCATGTACATCTCCGGTGTCCCT | SEQ ID NO: 1544 |
| | | RPr | CAGTGGCAGTCTTCCCTGTC | SEQ ID NO: 1545 |
| OSM | NM_020530.3 | FPr | GTTTCTGAAGGGGAGGTCAC | SEQ ID NO: 1546 |
| | | Probe | CTGAGCTGGCCTCCTATGCCTCAT | SEQ ID NO: 1547 |
| | | RPr | AGGTGTCTGGTTTGGGACA | SEQ ID NO: 1548 |
| OSMR | NM_003999.1 | FPr | GCTCATCATGGTCATGTGCT | SEQ ID NO: 1549 |
| | | Probe | CAGGTCTCCTTGATCCACTGACTTTTCA | SEQ ID NO: 1550 |
| | | RPr | TGTAAGGGTCAGGGATGTCA | SEQ ID NO: 1551 |
| P14ARF | S78535.1 | FPr | CCCTCGTGCTGATGCTACT | SEQ ID NO: 1552 |
| | | Probe | CTGCCCTAGACGCTGGCTCCTC | SEQ ID NO: 1553 |
| | | RPr | CATCATGACCTGGTCTTCTAGG | SEQ ID NO: 1554 |
| p16-INK4 | L27211.1 | FPr | GCGGAAGGTCCCTCAGACA | SEQ ID NO: 1555 |
| | | Probe | CTCAGAGCCTCTCTGGTTCTTTTCAATCGG | SEQ ID NO: 1556 |
| | | RPr | TGATGATCTAAGTTTCCCGAGGTT | SEQ ID NO: 1557 |
| p21 | NM_000389.1 | FPr | TGGAGACTCTCAGGGTCGAAA | SEQ ID NO: 1558 |
| | | Probe | CGGCGGCAGACCAGCATGAC | SEQ ID NO: 1559 |
| | | RPr | GGCGTTTGGAGTGGTAGAAATC | SEQ ID NO: 1560 |
| p27 | NM_004064.1 | FPr | CGGTGGACCACGAAGAGTTAA | SEQ ID NO: 1561 |
| | | Probe | CCGGGACTTGGAGAAGCACTGCA | SEQ ID NO: 1562 |
| | | RPr | GGCTCGCCTCTTCCATGTC | SEQ ID NO: 1563 |
| P53 | NM_000546.2 | FPr | CTTTGAACCCTTGCTTGCAA | SEQ ID NO: 1564 |
| | | Probe | AAGTCCTGGGTGCTTCTGACGCACA | SEQ ID NO: 1565 |
| | | RPr | CCCGGGACAAAGCAAATG | SEQ ID NO: 1566 |
| p53R2 | AB036063.1 | FPr | CCCAGCTAGTGTTCCTCAGA | SEQ ID NO: 1567 |
| | | Probe | TCGGCCAGCTTTTTCCAATCTTTG | SEQ ID NO: 1568 |
| | | RPr | CCGTAAGCCCTTCCTCTATG | SEQ ID NO: 1569 |
| PADI4 | NM_012387.1 | FPr | AGCAGTGGCTTGCTTTCTTC | SEQ ID NO: 1570 |
| | | Probe | CCTGTGATGTCCCAGTTTCCCACTC | SEQ ID NO: 1571 |
| | | RPr | TGCTAGGACCATGTTGGGAT | SEQ ID NO: 1572 |
| PAI1 | NM_000602.1 | FPr | CCGCAACGTGGTTTTCTCA | SEQ ID NO: 1573 |
| | | Probe | CTCGGTGTTGGCCATGCTCCAG | SEQ ID NO: 1574 |
| | | RPr | TGCTGGGTTCTCCTCCTGTT | SEQ ID NO: 1575 |
| Pak1 | NM_002576.3 | FPr | GAGCTGTGGGTTGTTATGGA | SEQ ID NO: 1576 |
| | | Probe | ACATCTGTCAAGGAGCCTCCAGCC | SEQ ID NO: 1577 |
| | | RPr | CCATGCAAGTTTCTGTCACC | SEQ ID NO: 1578 |
| PARC | NM_015089.1 | FPr | GGAGCTGACCTGCTTCCTAC | SEQ ID NO: 1579 |
| | | Probe | TCCTTATGCATCGAGGCCAGGC | SEQ ID NO: 1580 |
| | | RPr | AGCAGAGCACCACAGCATAG | SEQ ID NO: 1581 |
| PCAF | NM_003884.3 | FPr | AGGTGGCTGTGTTACTGCAA | SEQ ID NO: 1582 |
| | | Probe | TGCCACAGTTCTGCGACAGTCTACC | SEQ ID NO: 1583 |
| | | RPr | CACCTGTGTGGTTTCGTACC | SEQ ID NO: 1584 |
| PCNA | NM_002592.1 | FPr | GAAGGTGTTGGAGGCACTCAAG | SEQ ID NO: 1585 |
| | | Probe | ATCCCAGCAGGCCTCGTTGATGAG | SEQ ID NO: 1586 |
| | | RPr | GGTTTACACCGCTGGAGCTAA | SEQ ID NO: 1587 |
| PDGFA | NM_002607.2 | FPr | TTGTTGGTGTGCCCTGGTG | SEQ ID NO: 1588 |
| | | Probe | TGGTGGCGGTCACTCCCTCTGC | SEQ ID NO: 1589 |
| | | RPr | TGGGTTCTGTCCAAACACTGG | SEQ ID NO: 1590 |
| PDGFB | NM_002608.1 | FPr | ACTGAAGGAGACCCTTGGAG | SEQ ID NO: 1591 |
| | | Probe | TCTCCTGCCGATGCCCCTAGG | SEQ ID NO: 1592 |
| | | RPr | TAAATAACCCTGCCCACACA | SEQ ID NO: 1593 |
| PDGFC | NM_016205.1 | FPr | AGTTACTAAAAAATACCACGAGGTCCTT | SEQ ID NO: 1594 |
| | | Probe | CCCTGACACCGGTCTTTGGTCTCAACT | SEQ ID NO: 1595 |
| | | RPr | GTCGGTGAGTGATTTGTGCAA | SEQ ID NO: 1596 |

TABLE A-continued

| Gene | Accession | Reagt | Sequence | SEQ ID NO |
| --- | --- | --- | --- | --- |
| PDGFD | NM_025208.2 | FPr | TATCGAGGCAGGTCATACCA | SEQ ID NO: 1597 |
| | | Probe | TCCAGGTCAACTTTTGACTTCCGGT | SEQ ID NO: 1598 |
| | | RPr | TAACGCTTGGCATCATCATT | SEQ ID NO: 1599 |
| PDGFRa | NM_006206.2 | FPr | GGGAGTTTCCAAGAGATGGA | SEQ ID NO: 1600 |
| | | Probe | CCCAAGACCCGACCAAGCACTAG | SEQ ID NO: 1601 |
| | | RPr | CTTCAACCACCTTCCCAAAC | SEQ ID NO: 1602 |
| PDGFRb | NM_002609.2 | FPr | CCAGCTCTCCTTCCAGCTAC | SEQ ID NO: 1603 |
| | | Probe | ATCAATGTCCCTGTCCGAGTGCTG | SEQ ID NO: 1604 |
| | | RPr | GGGTGGCTCTCACTTAGCTC | SEQ ID NO: 1605 |
| PFN1 | NM_005022.2 | FPr | GGAAAACGTTCGTCAACATC | SEQ ID NO: 1606 |
| | | Probe | CAACCAGGACACCCACCTCAGCT | SEQ ID NO: 1607 |
| | | RPr | AAAACTTGACCGGTCTTTGC | SEQ ID NO: 1608 |
| PFN2 | NM_053024.1 | FPr | TCTATACGTCGATGGTGACTGC | SEQ ID NO: 1609 |
| | | Probe | CTCCCCACCTTGACTCTTTGTCCG | SEQ ID NO: 1610 |
| | | RPr | GCCGACAGCCACATTGTAT | SEQ ID NO: 1611 |
| PGK1 | NM_000291.1 | FPr | AGAGCCAGTTGCTGTAGAACTCAA | SEQ ID NO: 1612 |
| | | Probe | TCTCTGCTGGGCAAGGATGTTCTGTTC | SEQ ID NO: 1613 |
| | | RPr | CTGGGCCTACACAGTCCTTCA | SEQ ID NO: 1614 |
| PI3K | NM_002646.2 | FPr | TGCTACCTGGACAGCCCG | SEQ ID NO: 1615 |
| | | Probe | TCCTCCTGAAACGAGCTGTGTCTGACTT | SEQ ID NO: 1616 |
| | | RPr | AGGCCGTCCTTCAGTAACCA | SEQ ID NO: 1617 |
| PI3KC2A | NM_002645.1 | FPr | ATACCAATCACCGCACAAACC | SEQ ID NO: 1618 |
| | | Probe | TGCGCTGTGACTGGACTTAACAAATAGCCT | SEQ ID NO: 1619 |
| | | RPr | CACACTAGCATTTTCTCCGCATA | SEQ ID NO: 1620 |
| PIK3CA | NM_006218.1 | FPr | GTGATTGAAGAGCATGCCAA | SEQ ID NO: 1621 |
| | | Probe | TCCTGCTTCTCGGGATACAGACCA | SEQ ID NO: 1622 |
| | | RPr | GTCCTGCGTGGGAATAGC | SEQ ID NO: 1623 |
| PIM1 | NM_002648.2 | FPr | CTGCTCAAGGACACCGTCTA | SEQ ID NO: 1624 |
| | | Probe | TACACTCGGGTCCCATCGAAGTCC | SEQ ID NO: 1625 |
| | | RPr | GGATCCACTCTGGAGGGC | SEQ ID NO: 1626 |
| Pin1 | NM_006221.1 | FPr | GATCAACGGCTACATCCAGA | SEQ ID NO: 1627 |
| | | Probe | TCAAAGTCCTCCTCTCCCGACTTGA | SEQ ID NO: 1628 |
| | | RPr | TGAACTGTGAGGCCAGAGAC | SEQ ID NO: 1629 |
| PKD1 | NM_000296.2 | FPr | CAGCACCAGCGATTACGAC | SEQ ID NO: 1630 |
| | | Probe | AGCCATTGTGAGGACTCTCCCAGC | SEQ ID NO: 1631 |
| | | RPr | CTGAATAGGCCCACGTCC | SEQ ID NO: 1632 |
| PKR2 | NM_002654.3 | FPr | CCGCCTGGACATTGATTCAC | SEQ ID NO: 1633 |
| | | Probe | ACCCATCACAGCCCGGAACACTG | SEQ ID NO: 1634 |
| | | RPr | CTGGGCCAATGGTACAGATGA | SEQ ID NO: 1635 |
| PLA2G2A | NM_000300.2 | FPr | GCATCCCTCACCCATCCTA | SEQ ID NO: 1636 |
| | | Probe | AGGCCAGGCAGGAGCCCTTCTATA | SEQ ID NO: 1637 |
| | | RPr | GCTGGAAATCTGCTGGATGT | SEQ ID NO: 1638 |
| PLAUR | NM_002659.1 | FPr | CCCATGGATGCTCCTCTGAA | SEQ ID NO: 1639 |
| | | Probe | CATTGACTGCCGAGGCCCCATG | SEQ ID NO: 1640 |
| | | RPr | CCGGTGGCTACCAGACATTG | SEQ ID NO: 1641 |
| PLK | NM_005030.2 | FPr | AATGAATACAGTATTCCCAAGCACAT | SEQ ID NO: 1642 |
| | | Probe | AACCCCGTGGCCGCCTCC | SEQ ID NO: 1643 |
| | | RPr | TGTCTGAAGCATCTTCTGGATGA | SEQ ID NO: 1644 |
| PLK3 | NM_004073.2 | FPr | TGAAGGAGACGTACCGCTG | SEQ ID NO: 1645 |
| | | Probe | CAAGCAGGTTCACTACACGCTGCC | SEQ ID NO: 1646 |
| | | RPr | CAGGCAGTGAGAGGCTGG | SEQ ID NO: 1647 |
| PLOD2 | NM_000935.2 | FPr | CAGGGAGGTGGTTGCAAAT | SEQ ID NO: 1648 |
| | | Probe | TCCAGCCTTTTCGTGGTGACTCAA | SEQ ID NO: 1649 |
| | | RPr | TCTCCCAGGATGCATGAAG | SEQ ID NO: 1650 |
| PMS1 | NM_000534.2 | FPr | CTTACGGTTTTCGTGGAGAAG | SEQ ID NO: 1651 |
| | | Probe | CCTCAGCTATACAACAAATTGACCCCAAG | SEQ ID NO: 1652 |
| | | RPr | AGCAGCCGTTCTTGTTGTAA | SEQ ID NO: 1653 |

TABLE A-continued

| Gene | Accession | Reagt | Sequence | SEQ ID NO |
|---|---|---|---|---|
| PMS2 | NM_000535.2 | FPr | GATGTGGACTGCCATTCAAA | SEQ ID NO: 1654 |
| | | Probe | TCGAAATTTACATCCGGTATCTTCCTGG | SEQ ID NO: 1655 |
| | | RPr | TGCGAGATTAGTTGGCTGAG | SEQ ID NO: 1656 |
| PPARG | NM_005037.3 | FPr | TGACTTTATGGAGCCCAAGTT | SEQ ID NO: 1657 |
| | | Probe | TTCCAGTGCATTGAACTTCACAGCA | SEQ ID NO: 1658 |
| | | RPr | GCCAAGTCGCTGTCATCTAA | SEQ ID NO: 1659 |
| PPID | NM_005038.1 | FPr | TCCTCATTTGGATGGGAAAC | SEQ ID NO: 1660 |
| | | Probe | TTCCTTTAATTACTTGGCCAAACACCACA | SEQ ID NO: 1661 |
| | | RPr | CCAATATCCTTGCCACTCCTA | SEQ ID NO: 1662 |
| PPM1D | NM_003620.1 | FPr | GCCATCCGCAAAGGCTTT | SEQ ID NO: 1663 |
| | | Probe | TCGCTTGTCACCTTGCCATGTGG | SEQ ID NO: 1664 |
| | | RPr | GGCCATTCCGCCAGTTTC | SEQ ID NO: 1665 |
| PPP2R4 | NM_178001.1 | FPr | GGCTCAGAGCATAAGGCTTC | SEQ ID NO: 1666 |
| | | Probe | TTGGTCACTTCTCCCAACTTGGGC | SEQ ID NO: 1667 |
| | | RPr | ACGGGAACTCAGAAAACTGG | SEQ ID NO: 1668 |
| PR | NM_000926.2 | FPr | GCATCAGGCTGTCATTATGG | SEQ ID NO: 1669 |
| | | Probe | TGTCCTTACCTGTGGGAGCTGTAAGGTC | SEQ ID NO: 1670 |
| | | RPr | AGTAGTTGTGCTGCCCTTCC | SEQ ID NO: 1671 |
| PRDX2 | NM_005809.4 | FPr | GGTGTCCTTCGCCAGATCAC | SEQ ID NO: 1672 |
| | | Probe | TTAATGATTTGCCTGTGGGACGCTCC | SEQ ID NO: 1673 |
| | | RPr | CAGCCGCAGAGCCTCATC | SEQ ID NO: 1674 |
| PRDX3 | NM_006793.2 | FPr | TGACCCCAATGGAGTCATCA | SEQ ID NO: 1675 |
| | | Probe | CATTTGAGCGTCAACGATCTCCCAGTG | SEQ ID NO: 1676 |
| | | RPr | CCAAGCGGAGGGTTTCTTC | SEQ ID NO: 1677 |
| PRDX4 | NM_006406.1 | FPr | TTACCCATTTGGCCTGGATTAA | SEQ ID NO: 1678 |
| | | Probe | CCAAGTCCTCCTTGTCTTCGAGGGGT | SEQ ID NO: 1679 |
| | | RPr | CTGAAAGAAGTGGAATCCTTATTGG | SEQ ID NO: 1680 |
| PRDX6 | NM_004905.2 | FPr | CTGTGAGCCAGAGGATGTCA | SEQ ID NO: 1681 |
| | | Probe | CTGCCAATTGTGTTTTCCTGCAGC | SEQ ID NO: 1682 |
| | | RPr | TGTGATGACACCAGGATGTG | SEQ ID NO: 1683 |
| PRKCA | NM_002737.1 | FPr | CAAGCAATGCGTCATCAATGT | SEQ ID NO: 1684 |
| | | Probe | CAGCCTCTGCGGAATGGATCACACT | SEQ ID NO: 1685 |
| | | RPr | GTAAATCCGCCCCCTCTTCT | SEQ ID NO: 1686 |
| PRKCB1 | NM_002738.5 | FPr | GACCCAGCTCCACTCCTG | SEQ ID NO: 1687 |
| | | Probe | CCAGACCATGGACCGCCTGTACTT | SEQ ID NO: 1688 |
| | | RPr | CCCATTCACGTACTCCATCA | SEQ ID NO: 1689 |
| PRKCD | NM_006254.1 | FPr | CTGACACTTGCCGCAGAGAA | SEQ ID NO: 1690 |
| | | Probe | CCCTTTCTCACCCACCTCATCTGCAC | SEQ ID NO: 1691 |
| | | RPr | AGGTGGTCCTTGGTCTGGAA | SEQ ID NO: 1692 |
| PRKR | NM_002759.1 | FPr | GCGATACATGAGCCCAGAACA | SEQ ID NO: 1693 |
| | | Probe | AGGTCCACTTCCTTTCCATAGTCTTGCGA | SEQ ID NO: 1694 |
| | | RPr | TCAGCAAGAATTAGCCCCAAAG | SEQ ID NO: 1695 |
| pS2 | NM_003225.1 | FPr | GCCCTCCCAGTGTGCAAAT | SEQ ID NO: 1696 |
| | | Probe | TGCTGTTTCGACGACACCGTTCG | SEQ ID NO: 1697 |
| | | RPr | CGTCGATGGTATTAGGATAGAAGCA | SEQ ID NO: 1698 |
| PTCH | NM_000264.2 | FPr | CCACGACAAAGCCGACTAC | SEQ ID NO: 1699 |
| | | Probe | CCTGAAACAAGGCTGAGAATCCCG | SEQ ID NO: 1700 |
| | | RPr | TACTCGATGGGCTCTGCTG | SEQ ID NO: 1701 |
| PTEN | NM_000314.1 | FPr | TGGCTAAGTGAAGATGACAATCATG | SEQ ID NO: 1702 |
| | | Probe | CCTTTCCAGCTTTACAGTGAATTGCTGCA | SEQ ID NO: 1703 |
| | | RPr | TGCACATATCATTACACCAGTTCGT | SEQ ID NO: 1704 |
| PTGER3 | NM_000957.2 | FPr | TAACTGGGGCAACCTTTTCT | SEQ ID NO: 1705 |
| | | Probe | CCTTTGCCTTCCTGGGGCTCTT | SEQ ID NO: 1706 |
| | | RPr | TTGCAGGAAAAGGTGACTGT | SEQ ID NO: 1707 |
| PTHLH | NM_002820.1 | FPr | AGTGACTGGGAGTGGGCTAGAA | SEQ ID NO: 1708 |
| | | Probe | TGACACCTCCACAACGTCGCTGGA | SEQ ID NO: 1709 |
| | | RPr | AAGCCTGTTACCGTGAATCGA | SEQ ID NO: 1710 |

TABLE A-continued

| Gene | Accession | Reagt | Sequence | SEQ ID NO |
|---|---|---|---|---|
| PTHR1 | NM_000316.1 | FPr | CGAGGTACAAGCTGAGATCAAGAA | SEQ ID NO: 1711 |
| | | Probe | CCAGTGCCAGTGTCCAGCGGCT | SEQ ID NO: 1712 |
| | | RPr | GCGTGCCTTTCGCTTGAA | SEQ ID NO: 1713 |
| PTK2 | NM_005607.3 | FPr | GACCGGTCGAATGATAAGGT | SEQ ID NO: 1714 |
| | | Probe | ACCAGGCCCGTCACATTCTCGTAC | SEQ ID NO: 1715 |
| | | RPr | CTGGACATCTCGATGACAGC | SEQ ID NO: 1716 |
| PTK2B | NM_004103.3 | FPr | CAAGCCCAGCCGACCTAAG | SEQ ID NO: 1717 |
| | | Probe | CTCCGCAAACCAACCTCCTGGCT | SEQ ID NO: 1718 |
| | | RPr | GAACCTGGAACTGCAGCTTTG | SEQ ID NO: 1719 |
| PTP4A3 | NM_007079.2 | FPr | CCTGTTCTCGGCACCTTAAA | SEQ ID NO: 1720 |
| | | Probe | ACCTGACTGCCCCGGGGTCTAATA | SEQ ID NO: 1721 |
| | | RPr | TATTGCCTTCGGGTGTCC | SEQ ID NO: 1722 |
| PTP4A3 v2 | NM_032611.1 | FPr | AATATTTGTGCGGGGTATGG | SEQ ID NO: 1723 |
| | | Probe | CCAAGAGAAACGAGATTTAAAAACCCACC | SEQ ID NO: 1724 |
| | | RPr | AACGAGATCCCTGTGCTTGT | SEQ ID NO: 1725 |
| PTPD1 | NM_007039.2 | FPr | CGCTTGCCTAACTCATACTTTCC | SEQ ID NO: 1726 |
| | | Probe | TCCACGCAGCGTGGCACTG | SEQ ID NO: 1727 |
| | | RPr | CCATTCAGACTGCGCCACTT | SEQ ID NO: 1728 |
| PTPN1 | NM_002827.2 | FPr | AATGAGGAAGTTTCGGATGG | SEQ ID NO: 1729 |
| | | Probe | CTGATCCAGACAGCCGACCAGCT | SEQ ID NO: 1730 |
| | | RPr | CTTCGATCACAGCCAGGTAG | SEQ ID NO: 1731 |
| PTPRF | NM_002840.2 | FPr | TGTTTTAGCTGAGGGACGTG | SEQ ID NO: 1732 |
| | | Probe | CCGACGTCCCCAAACCTAGCTAGG | SEQ ID NO: 1733 |
| | | RPr | TACCAACCCTGGAATGTTGA | SEQ ID NO: 1734 |
| PTPRJ | NM_002843.2 | FPr | AACTTCCGGTACCTCGTTCGT | SEQ ID NO: 1735 |
| | | Probe | ACTACATGAAGCAGAGTCCTCCCGAATCG | SEQ ID NO: 1736 |
| | | RPr | AGCACTGCAATGCACCAGAA | SEQ ID NO: 1737 |
| PTPRO | NM_030667.1 | FPr | CATGGCCTGATCATGGTGT | SEQ ID NO: 1738 |
| | | Probe | CCCACAGCAAATGCTGCAGAAAGT | SEQ ID NO: 1739 |
| | | RPr | CCATGTGTACAAACTGCAGGA | SEQ ID NO: 1740 |
| PTTG1 | NM_004219.2 | FPr | GGCTACTCTGATCTATGTTGATAAGGAA | SEQ ID NO: 1741 |
| | | Probe | CACACGGGTGCCTGGTTCTCCA | SEQ ID NO: 1742 |
| | | RPr | GCTTCAGCCCATCCTTAGCA | SEQ ID NO: 1743 |
| RAB32 | NM_006834.2 | FPr | CCTGCAGCTGTGGGACAT | SEQ ID NO: 1744 |
| | | Probe | CGATTTGGCAACATGACCCGAGTA | SEQ ID NO: 1745 |
| | | RPr | AGCACCAACAGCTTCCTTG | SEQ ID NO: 1746 |
| RAB6C | NM_032144.1 | FPr | GCGACAGCTCCTCTAGTTCCA | SEQ ID NO: 1747 |
| | | Probe | TTCCCGAAGTCTCCGCCCG | SEQ ID NO: 1748 |
| | | RPr | GGAACACCAGCTTGAATTCCT | SEQ ID NO: 1749 |
| RAC1 | NM_006908.3 | FPr | TGTTGTAAATGTCTCAGCCCC | SEQ ID NO: 1750 |
| | | Probe | CGTTCTTGGTCCTGTCCCTTGGA | SEQ ID NO: 1751 |
| | | RPr | TTGAGCAAAGCGTACAAAGG | SEQ ID NO: 1752 |
| RAD51C | NM_058216.1 | FPr | GAACTTCTTGAGCAGGAGCATACC | SEQ ID NO: 1753 |
| | | Probe | AGGGCTTCATAATCACCTTCTGTTC | SEQ ID NO: 1754 |
| | | RPr | TCCACCCCAAGAATATCATCTAGT | SEQ ID NO: 1755 |
| RAD54L | NM_003579.2 | FPr | AGCTAGCCTCAGTGACACACATG | SEQ ID NO: 1756 |
| | | Probe | ACACAACGTCGGCAGTGCAACCTG | SEQ ID NO: 1757 |
| | | RPr | CCGGATCTGACGGCTGTT | SEQ ID NO: 1758 |
| RAF1 | NM_002880.1 | FPr | CGTCGTATGCGAGAGTCTGT | SEQ ID NO: 1759 |
| | | Probe | TCCAGGATGCCTGTTAGTTCTCAGCA | SEQ ID NO: 1760 |
| | | RPr | TGAAGGCGTGAGGTGTAGAA | SEQ ID NO: 1761 |
| RALBP1 | NM_006788.2 | FPr | GGTGTCAGATATAAATGTGCAAATGC | SEQ ID NO: 1762 |
| | | Probe | TGCTGTCCTGTCGGTCTCAGTACGTTCA | SEQ ID NO: 1763 |
| | | RPr | TTCGATATTGCCAGCAGCTATAAA | SEQ ID NO: 1764 |
| RANBP2 | NM_006267.3 | FPr | TCCTTCAGCTTTCACACTGG | SEQ ID NO: 1765 |
| | | Probe | TCCAGAAGAGTCATGCAACTTCATTTCTG | SEQ ID NO: 1766 |
| | | RPr | AAATCCTGTTCCCACCTGAC | SEQ ID NO: 1767 |

TABLE A-continued

| Gene | Accession | Reagt | Sequence | SEQ ID NO |
|---|---|---|---|---|
| ranBP7 | NM_006391.1 | FPr | AACATGATTATCCAAGCCGC | SEQ ID NO: 1768 |
| | | Probe | AAGCCAATTTTGTCCACAATGGCA | SEQ ID NO: 1769 |
| | | RPr | GCCAACAAGCACTGTTATCG | SEQ ID NO: 1770 |
| RANBP9 | NM_005493.2 | FPr | CAAGTCAGTTGAGACGCCAGTT | SEQ ID NO: 1771 |
| | | Probe | TTCTATGGCGGCCTGACTTCCTCCA | SEQ ID NO: 1772 |
| | | RPr | TGCAGCTCTCGTCCAAAGTG | SEQ ID NO: 1773 |
| RAP1GDS1 | NM_021159.3 | FPr | TGTGGATGCTGGATTGATTT | SEQ ID NO: 1774 |
| | | Probe | CCACTGGTGCAGCTGCTAAATAGCA | SEQ ID NO: 1775 |
| | | RPr | AAGCAGCACTTCCTGGTCTT | SEQ ID NO: 1776 |
| RARA | NM_000964.1 | FPr | AGTCTGTGAGAAACGACCGAAAC | SEQ ID NO: 1777 |
| | | Probe | TCGGGCTTGGGCACCTCCTTCTT | SEQ ID NO: 1778 |
| | | RPr | CGGCGTCAGCGTGTAGCT | SEQ ID NO: 1779 |
| RARB | NM_016152.2 | FPr | TGCCTGGACATCCTGATTCT | SEQ ID NO: 1780 |
| | | Probe | TGCACCAGGTATACCCCAGAACAAGA | SEQ ID NO: 1781 |
| | | RPr | AAGGCCGTCTGAGAAAGTCA | SEQ ID NO: 1782 |
| RASSF1 | NM_007182.3 | FPr | AGTGGGAGACACCTGACCTT | SEQ ID NO: 1783 |
| | | Probe | TTGATCTTCTGCTCAATCTCAGCTTGAGA | SEQ ID NO: 1784 |
| | | RPr | TGATCTGGGCATTGTACTCC | SEQ ID NO: 1785 |
| RBM5 | NM_005778.1 | FPr | CGAGAGGGAGAGCAAGACCAT | SEQ ID NO: 1786 |
| | | Probe | CTGCGCGGCCTTCCCATCA | SEQ ID NO: 1787 |
| | | RPr | TCTCGAATATCGCTCTCTGTGATG | SEQ ID NO: 1788 |
| RBX1 | NM_014248.2 | FPr | GGAACCACATTATGGATCTTTGC | SEQ ID NO: 1789 |
| | | Probe | TAGAATGTCAAGCTAACCAGGCGTCCGC | SEQ ID NO: 1790 |
| | | RPr | CATGCGACAGTACACTCTTCTGAA | SEQ ID NO: 1791 |
| RCC1 | NM_001269.2 | FPr | GGGCTGGGTGAGAATGTG | SEQ ID NO: 1792 |
| | | Probe | ATACCAGGGCCGGCTTCTTCCTCT | SEQ ID NO: 1793 |
| | | RPr | CACAACATCCTCCGGAATG | SEQ ID NO: 1794 |
| REG4 | NM_032044.2 | FPr | TGCTAACTCCTGCACAGCC | SEQ ID NO: 1795 |
| | | Probe | TCCTCTTCCTTTCTGCTAGCCTGGC | SEQ ID NO: 1796 |
| | | RPr | TGCTAGGTTTCCCCTCTGAA | SEQ ID NO: 1797 |
| RFC | NM_003056.1 | FPr | TCAAGACCATCATCACTTTCATTGT | SEQ ID NO: 1798 |
| | | Probe | CCTCCCGGTCCGCAAGCAGTT | SEQ ID NO: 1799 |
| | | RPr | GGATCAGGAAGTACACGGAGTATAACT | SEQ ID NO: 1800 |
| RhoB | NM_004040.2 | FPr | AAGCATGAACAGGACTTGACC | SEQ ID NO: 1801 |
| | | Probe | CTTTCCAACCCCTGGGGAAGACAT | SEQ ID NO: 1802 |
| | | RPr | CCTCCCCAAGTCAGTTGC | SEQ ID NO: 1803 |
| rhoC | NM_175744.1 | FPr | CCCGTTCGGTCTGAGGAA | SEQ ID NO: 1804 |
| | | Probe | TCCGGTTCGCCATGTCCCG | SEQ ID NO: 1805 |
| | | RPr | GAGCACTCAAGGTAGCCAAAGG | SEQ ID NO: 1806 |
| RIZ1 | NM_012231.1 | FPr | CCAGACGAGCGATTAGAAGC | SEQ ID NO: 1807 |
| | | Probe | TGTGAGGTGAATGATTGGGGGA | SEQ ID NO: 1808 |
| | | RPr | TCCTCCTCTTCCTCCTCCTC | SEQ ID NO: 1809 |
| RNF11 | NM_014372.3 | FPr | ACCCTGGAAGAGATGGATCA | SEQ ID NO: 1810 |
| | | Probe | CCATCATACAGATCACACACTCCCGG | SEQ ID NO: 1811 |
| | | RPr | ATTGGGTCCCCATAAACAAA | SEQ ID NO: 1812 |
| ROCK1 | NM_005406.1 | FPr | TGTGCACATAGGAATGAGCTTC | SEQ ID NO: 1813 |
| | | Probe | TCACTCTCTTTGCTGGCCAACTGC | SEQ ID NO: 1814 |
| | | RPr | GTTTAGCACGCAATTGCTCA | SEQ ID NO: 1815 |
| ROCK2 | NM_004850.3 | FPr | GATCCGAGACCCTCGCTC | SEQ ID NO: 1816 |
| | | Probe | CCCATCAACGTGGAGAGCTTGCT | SEQ ID NO: 1817 |
| | | RPr | AGGACCAAGGAATTTAAGCCA | SEQ ID NO: 1818 |
| RPLPO | NM_001002.2 | FPr | CCATTCTATCATCAACGGGTACAA | SEQ ID NO: 1819 |
| | | Probe | TCTCCACAGACAAGGCCAGGACTCG | SEQ ID NO: 1820 |
| | | RPr | TCAGCAAGTGGGAAGGTGTAATC | SEQ ID NO: 1821 |
| RPS13 | NM_001017.2 | FPr | CAGTCGGCTTTACCCTATCG | SEQ ID NO: 1822 |
| | | Probe | CAACTTCAACCAAGTGGGGACGCT | SEQ ID NO: 1823 |
| | | RPr | TCTGCTCCTTCACGTCGTC | SEQ ID NO: 1824 |

TABLE A-continued

| Gene | Accession | Reagt | Sequence | SEQ ID NO |
|---|---|---|---|---|
| RRM1 | NM_001033.1 | FPr | GGGCTACTGGCAGCTACATT | SEQ ID NO: 1825 |
| | | Probe | CATTGGAATTGCCATTAGTCCCAGC | SEQ ID NO: 1826 |
| | | RPr | CTCTCAGCATCGGTACAAGG | SEQ ID NO: 1827 |
| RRM2 | NM_001034.1 | FPr | CAGCGGGATTAAACAGTCCT | SEQ ID NO: 1828 |
| | | Probe | CCAGCACAGCCAGTTAAAAGATGCA | SEQ ID NO: 1829 |
| | | RPr | ATCTGCGTTGAAGCAGTGAG | SEQ ID NO: 1830 |
| RTN4 | NM_007008.1 | FPr | GACTGGAGTGGTGTTTGGTG | SEQ ID NO: 1831 |
| | | Probe | CCAGCCTATTCCTGCTGCTTTCATTG | SEQ ID NO: 1832 |
| | | RPr | CTGTTACGCTCACAATGCTG | SEQ ID NO: 1833 |
| RUNX1 | NM_001754.2 | FPr | AACAGAGACATTGCCAACCA | SEQ ID NO: 1834 |
| | | Probe | TTGGATCTGCTTGCTGTCCAAACC | SEQ ID NO: 1835 |
| | | RPr | GTGATTTGCCCAGGAAGTTT | SEQ ID NO: 1836 |
| RXRA | NM_002957.3 | FPr | GCTCTGTTGTGTCCTGTTGC | SEQ ID NO: 1837 |
| | | Probe | TCAGTCACAGGAAGGCCAGAGCC | SEQ ID NO: 1838 |
| | | RPr | GTACGGAGAAGCCACTTCACA | SEQ ID NO: 1839 |
| S100A1 | NM_006271.1 | FPr | TGGACAAGGTGATGAAGGAG | SEQ ID NO: 1840 |
| | | Probe | CCTCCCCGTCTCCATTCTCGTCTA | SEQ ID NO: 1841 |
| | | RPr | AGCACCACATACTCCTGGAA | SEQ ID NO: 1842 |
| S100A2 | NM_005978.2 | FPr | TGGCTGTGCTGGTCACTACCT | SEQ ID NO: 1843 |
| | | Probe | CACAAGTACTCCTGCCAAGAGGGCGAC | SEQ ID NO: 1844 |
| | | RPr | TCCCCCTTACTCAGCTTGAACT | SEQ ID NO: 1845 |
| S100A4 | NM_002961.2 | FPr | GACTGCTGTCATGGCGTG | SEQ ID NO: 1846 |
| | | Probe | ATCACATCCAGGGCCTTCTCCAGA | SEQ ID NO: 1847 |
| | | RPr | CGAGTACTTGTGGAAGGTGGAC | SEQ ID NO: 1848 |
| S100A8 | NM_002964.3 | FPr | ACTCCCTGATAAAGGGGAATTT | SEQ ID NO: 1849 |
| | | Probe | CATGCCGTCTACAGGGATGACCTG | SEQ ID NO: 1850 |
| | | RPr | TGAGGACACTCGGTCTCTAGC | SEQ ID NO: 1851 |
| S100A9 | NM_002965.2 | FPr | CTTTGGGACAGAGTGCAAGA | SEQ ID NO: 1852 |
| | | Probe | CGATGACTTGCAAAATGTCGCAGC | SEQ ID NO: 1853 |
| | | RPr | TGGTCTCTATGTTGCGTTCC | SEQ ID NO: 1854 |
| S100P | NM_005980.2 | FPr | AGACAAGGATGCCGTGGATAA | SEQ ID NO: 1855 |
| | | Probe | TTGCTCAAGGACCTGGACGCCAA | SEQ ID NO: 1856 |
| | | RPr | GAAGTCCACCTGGGCATCTC | SEQ ID NO: 1857 |
| SAT | NM_002970.1 | FPr | CCTTTTACCACTGCCTGGTT | SEQ ID NO: 1858 |
| | | Probe | TCCAGTGCTCTTTCGGCACTTCTG | SEQ ID NO: 1859 |
| | | RPr | ACAATGCTGTGTCCTTCCG | SEQ ID NO: 1860 |
| SBA2 | NM_018639.3 | FPr | GGACTCAACGATGGGCAG | SEQ ID NO: 1861 |
| | | Probe | CCCTGTCTGCACCTCCCAGATCTT | SEQ ID NO: 1862 |
| | | RPr | CGGAAAGATTCAAAAGCAGG | SEQ ID NO: 1863 |
| SDC1 | NM_002997.1 | FPr | GAAATTGACGAGGGGTGTCT | SEQ ID NO: 1864 |
| | | Probe | CTCTGAGCGCCTCCATCCAAGG | SEQ ID NO: 1865 |
| | | RPr | AGGAGCTAACGGAGAACCTG | SEQ ID NO: 1866 |
| SEMA3B | NM_004636.1 | FPr | GCTCCAGGATGTGTTTCTGTTG | SEQ ID NO: 1867 |
| | | Probe | TCGCGGGACCACCGGACC | SEQ ID NO: 1868 |
| | | RPr | ACGTGGAGAAGACGGCATAGA | SEQ ID NO: 1869 |
| SEMA3F | NM_004186.1 | FPr | CGCGAGCCCCTCATTATACA | SEQ ID NO: 1870 |
| | | Probe | CTCCCCACAGCGCATCGAGGAA | SEQ ID NO: 1871 |
| | | RPr | CACTCGCCGTTGACATCCT | SEQ ID NO: 1872 |
| SEMA4B | NM_020210.1 | FPr | TTCCAGCCCAACACAGTGAA | SEQ ID NO: 1873 |
| | | Probe | ACTTTGGCCTGCCCGCTCCTCT | SEQ ID NO: 1874 |
| | | RPr | GAGTCGGGTCGCCAGGTT | SEQ ID NO: 1875 |
| SFRP2 | NM_003013.2 | FPr | CAAGCTGAACGGTGTGTCC | SEQ ID NO: 1876 |
| | | Probe | CAGCACCGATTTCTTCAGGTCCCT | SEQ ID NO: 1877 |
| | | RPr | TGCAAGCTGTCTTTGAGCC | SEQ ID NO: 1878 |
| SFRP4 | NM_003014.2 | FPr | TACAGGATGAGGCTGGGC | SEQ ID NO: 1879 |
| | | Probe | CCTGGGACAGCCTATGTAAGGCCA | SEQ ID NO: 1880 |
| | | RPr | GTTGTTAGGGCAAGGGGC | SEQ ID NO: 1881 |

TABLE A-continued

| Gene | Accession | Reagt | Sequence | SEQ ID NO |
|---|---|---|---|---|
| SGCB | NM_000232.1 | FPr | CAGTGGAGACCAGTTGGGTAGTG | SEQ ID NO: 1882 |
| | | Probe | CACACATGCAGAGCTTGTAGCGTACCCA | SEQ ID NO: 1883 |
| | | RPr | CCTTGAAGAGCGTCCCATCA | SEQ ID NO: 1884 |
| SHC1 | NM_003029.3 | FPr | CCAACACCTTCTTGGCTTCT | SEQ ID NO: 1885 |
| | | Probe | CCTGTGTTCTTGCTGAGCACCCTC | SEQ ID NO: 1886 |
| | | RPr | CTGTTATCCCAACCCAAACC | SEQ ID NO: 1887 |
| SHH | NM_000193.2 | FPr | GTCCAAGGCACATATCCACTG | SEQ ID NO: 1888 |
| | | Probe | CACCGAGTTCTCTGCTTTCACCGA | SEQ ID NO: 1889 |
| | | RPr | GAAGCAGCCTCCCGATTT | SEQ ID NO: 1890 |
| SI | NM_001041.1 | FPr | AACGGACTCCCTCAATTTGT | SEQ ID NO: 1891 |
| | | Probe | TGTCCATGGTCATGCAAATCTTGC | SEQ ID NO: 1892 |
| | | RPr | GAAATTGCAGGGTCCAAGAT | SEQ ID NO: 1893 |
| Siah-1 | NM_003031.2 | FPr | TTGGCATTGGAACTACATTCA | SEQ ID NO: 1894 |
| | | Probe | TCCGCGGTATCCTCGGATTAGTTC | SEQ ID NO: 1895 |
| | | RPr | GGTATGGAGAAGGGGGTCC | SEQ ID NO: 1896 |
| SIAT4A | NM_003033.2 | FPr | AACCACAGTTGGAGGAGGAC | SEQ ID NO: 1897 |
| | | Probe | CAGAGACAGTTTCCCTCCCCGCT | SEQ ID NO: 1898 |
| | | RPr | CGAAGGAAGGGTGTTGGTAT | SEQ ID NO: 1899 |
| SIAT7B | NM_006456.1 | FPr | TCCAGCCCAAATCCTCCT | SEQ ID NO: 1900 |
| | | Probe | TGGCACATCCTACCCCAGATGCTA | SEQ ID NO: 1901 |
| | | RPr | GGTGTCCTGGAGTCCTTGAA | SEQ ID NO: 1902 |
| SIM2 | NM_005069.2 | FPr | GATGGTAGGAAGGGATGTGC | SEQ ID NO: 1903 |
| | | Probe | CGCCTCTCCACGCACTCAGCTAT | SEQ ID NO: 1904 |
| | | RPr | CACAAGGAGCTGTGAATGAGG | SEQ ID NO: 1905 |
| SIN3A | NM_015477.1 | FPr | CCAGAGTCATGCTCATCCAG | SEQ ID NO: 1906 |
| | | Probe | CTGTCCCTGCACTGGTGCAACTG | SEQ ID NO: 1907 |
| | | RPr | CCACCTTCAGCCTCTGAAAT | SEQ ID NO: 1908 |
| SIR2 | NM_012238.3 | FPr | AGCTGGGGTGTCTGTTTCAT | SEQ ID NO: 1909 |
| | | Probe | CCTGACTTCAGGTCAAGGGATGG | SEQ ID NO: 1910 |
| | | RPr | ACAGCAAGGCGAGCATAAAT | SEQ ID NO: 1911 |
| SKP1A | NM_006930.2 | FPr | CCATTGCCTTTGCTTTGTTCAT | SEQ ID NO: 1912 |
| | | Probe | TCCCATGGTTTTTATTCTGCCCTGCTG | SEQ ID NO: 1913 |
| | | RPr | TTCCGGATTTCCTTTCTTTGC | SEQ ID NO: 1914 |
| SKP2 | NM_005983.2 | FPr | AGTTGCAGAATCTAAGCCTGGAA | SEQ ID NO: 1915 |
| | | Probe | CCTGCGGCTTTCGGATCCCA | SEQ ID NO: 1916 |
| | | RPr | TGAGTTTTTTGCGAGAGTATTGACA | SEQ ID NO: 1917 |
| SLC25A3 | NM_213611.1 | FPr | TCTGCCAGTGCTGAATTCTT | SEQ ID NO: 1918 |
| | | Probe | TGCTGACATTGCCCTGGCTCCTAT | SEQ ID NO: 1919 |
| | | RPr | TTCGAACCTTAGCAGCTTCC | SEQ ID NO: 1920 |
| SLC2A1 | NM_006516.1 | FPr | GCCTGAGTCTCCTGTGCC | SEQ ID NO: 1921 |
| | | Probe | ACATCCCAGGCTTCACCCTGAATG | SEQ ID NO: 1922 |
| | | RPr | AGTCTCCACCCTCAGGCAT | SEQ ID NO: 1923 |
| SLC31A1 | NM_001859.2 | FPr | CCGTTCGAAGAGTCGTGAG | SEQ ID NO: 1924 |
| | | Probe | TCTCCGAATCTTAACCCGTCACCC | SEQ ID NO: 1925 |
| | | RPr | AGTCCAGCCACTAGCACCTC | SEQ ID NO: 1926 |
| SLC5A8 | NM_145913.2 | FPr | CCTGCTTTCAACCACATTGA | SEQ ID NO: 1927 |
| | | Probe | TCCCATTGCTCTTGCCACTCTGAT | SEQ ID NO: 1928 |
| | | RPr | AGAGCAGCTTCACAAACGAG | SEQ ID NO: 1929 |
| SLC7A5 | NM_003486.4 | FPr | GCGCAGAGGCCAGTTAAA | SEQ ID NO: 1930 |
| | | Probe | AGATCACCTCCTCGAACCCACTCC | SEQ ID NO: 1931 |
| | | RPr | AGCTGAGCTGTGGGTTGC | SEQ ID NO: 1932 |
| SLPI | NM_003064.2 | FPr | ATGGCCAATGTTTGATGCT | SEQ ID NO: 1933 |
| | | Probe | TGGCCATCCATCTCACAGAAATTGG | SEQ ID NO: 1934 |
| | | RPr | ACACTTCAAGTCACGCTTGC | SEQ ID NO: 1935 |
| SMARCA3 | NM_003071.2 | FPr | AGGGACTGTCCTGGCACAT | SEQ ID NO: 1936 |
| | | Probe | AGCAAAAGACCCAGGACATCTGCA | SEQ ID NO: 1937 |
| | | RPr | CAACAAATTTGCCGCAGTC | SEQ ID NO: 1938 |

TABLE A-continued

| Gene | Accession | Reagt | Sequence | SEQ ID NO |
|---|---|---|---|---|
| SNAI1 | NM_005985.2 | FPr | CCCAATCGGAAGCCTAACTA | SEQ ID NO: 1939 |
| | | Probe | TCTGGATTAGAGTCCTGCAGCTCGC | SEQ ID NO: 1940 |
| | | RPr | GTAGGGCTGCTGGAAGGTAA | SEQ ID NO: 1941 |
| SNAI2 | NM_003068.3 | FPr | GGCTGGCCAAACATAAGCA | SEQ ID NO: 1942 |
| | | Probe | CTGCACTGCGATGCCCAGTCTAGAAAATC | SEQ ID NO: 1943 |
| | | RPr | TCCTTGTCACAGTATTTACAGCTGAA | SEQ ID NO: 1944 |
| SNRPF | NM_003095.1 | FPr | GGCTGGTCGGCAGAGAGTAG | SEQ ID NO: 1945 |
| | | Probe | AAACTCATGTAAACCACGGCCGAATGTTG | SEQ ID NO: 1946 |
| | | RPr | TGAGGAAAGGTTTGGGATTGA | SEQ ID NO: 1947 |
| SOD1 | NM_000454.3 | FPr | TGAAGAGAGGCATGTTGGAG | SEQ ID NO: 1948 |
| | | Probe | TTTGTCAGCAGTCACATTGCCCAA | SEQ ID NO: 1949 |
| | | RPr | AATAGACACATCGGCCACAC | SEQ ID NO: 1950 |
| SOD2 | NM_000636.1 | FPr | GCTTGTCCAAATCAGGATCCA | SEQ ID NO: 1951 |
| | | Probe | AACAACAGGCCTTATTCCACTGCTGGG | SEQ ID NO: 1952 |
| | | RPr | AGCGTGCTCCCACACATCA | SEQ ID NO: 1953 |
| SOS1 | NM_005633.2 | FPr | TCTGCACCAAATTCTCCAAG | SEQ ID NO: 1954 |
| | | Probe | AACACCGTTAACACCTCCGCCTG | SEQ ID NO: 1955 |
| | | RPr | GTGGTACTGGAAGCACCAGA | SEQ ID NO: 1956 |
| SOX17 | NM_022454.2 | FPr | TCGTGTGCAAGCCTGAGA | SEQ ID NO: 1957 |
| | | Probe | CTCCCCTACCAGGGGCATGACTC | SEQ ID NO: 1958 |
| | | RPr | CTGTCGGGGAGATTCACAC | SEQ ID NO: 1959 |
| SPARC | NM_003118.1 | FPr | TCTTCCCTGTACACTGGCAGTTC | SEQ ID NO: 1960 |
| | | Probe | TGGACCAGCACCCATTGACGG | SEQ ID NO: 1961 |
| | | RPr | AGCTCGGTGTGGGAGAGGTA | SEQ ID NO: 1962 |
| SPINT2 | NM_021102.1 | FPr | AGGAATGCAGCGGATTCCT | SEQ ID NO: 1963 |
| | | Probe | CCCAAGTGCTCCCAGAAGGCAGG | SEQ ID NO: 1964 |
| | | RPr | TCGCTGGAGTGGTCTTCAGA | SEQ ID NO: 1965 |
| SPRY1 | AK026960.1 | FPr | CAGACCAGTCCCTGGTCATAGG | SEQ ID NO: 1966 |
| | | Probe | CTGGGTCCGGATTGCCCTTTCAG | SEQ ID NO: 1967 |
| | | RPr | CCTTCAAGTCATCCACAATCAGTT | SEQ ID NO: 1968 |
| SPRY2 | NM_005842.1 | FPr | TGTGGCAAGTGCAAATGTAA | SEQ ID NO: 1969 |
| | | Probe | CAGAGGCCTTGGGTAGGTGCACTC | SEQ ID NO: 1970 |
| | | RPr | GTCGCAGATCCAGTCTGATG | SEQ ID NO: 1971 |
| SR-A1 | NM_021228.1 | FPr | AGATGGAAGAAGCCAACCTG | SEQ ID NO: 1972 |
| | | Probe | CTGGATCAGCTCCTGGGCCTTC | SEQ ID NO: 1973 |
| | | RPr | CTGTGGCTGAGGATCTGGT | SEQ ID NO: 1974 |
| ST14 | NM_021978.2 | FPr | TGACTGCACATGGAACATTG | SEQ ID NO: 1975 |
| | | Probe | AGGTGCCCAACAACCAGCATGT | SEQ ID NO: 1976 |
| | | RPr | AAGAATTTGAAGCGCACCTT | SEQ ID NO: 1977 |
| STAT1 | NM_007315.1 | FPr | GGGCTCAGCTTTCAGAAGTG | SEQ ID NO: 1978 |
| | | Probe | TGGCAGTTTTCTTCTGTCACCAAAA | SEQ ID NO: 1979 |
| | | RPr | ACATGTTCAGCTGGTCCACA | SEQ ID NO: 1980 |
| STAT3 | NM_003150.1 | FPr | TCACATGCCACTTTGGTGTT | SEQ ID NO: 1981 |
| | | Probe | TCCTGGGAGAGATTGACCAGCA | SEQ ID NO: 1982 |
| | | RPr | CTTGCAGGAAGCGGCTATAC | SEQ ID NO: 1983 |
| STAT5A | NM_003152.1 | FPr | GAGGCGCTCAACATGAAATTC | SEQ ID NO: 1984 |
| | | Probe | CGGTTGCTCTGCACTTCGGCCT | SEQ ID NO: 1985 |
| | | RPr | GCCAGGAACACGAGGTTCTC | SEQ ID NO: 1986 |
| STAT5B | NM_012448.1 | FPr | CCAGTGGTGGTGATCGTTCA | SEQ ID NO: 1987 |
| | | Probe | CAGCCAGGACAACAATGCGACGG | SEQ ID NO: 1988 |
| | | RPr | GCAAAAGCATTGTCCCAGAGA | SEQ ID NO: 1989 |
| STC1 | NM_003155.1 | FPr | CTCCGAGGTGAGGAGGACT | SEQ ID NO: 1990 |
| | | Probe | CACATCAAACGCACATCCCATGAG | SEQ ID NO: 1991 |
| | | RPr | ACCTCTCCCTGGTTATGCAC | SEQ ID NO: 1992 |
| STK11 | NM_000455.3 | FPr | GGACTCGGAGACGCTGTG | SEQ ID NO: 1993 |
| | | Probe | TTCTTGAGGATCTTGACGGCCCTC | SEQ ID NO: 1994 |
| | | RPr | GGGATCCTTCGCAACTTCTT | SEQ ID NO: 1995 |

TABLE A-continued

| Gene | Accession | Reagt | Sequence | SEQ ID NO |
|---|---|---|---|---|
| STK15 | NM_003600.1 | FPr | CATCTTCCAGGAGGACCACT | SEQ ID NO: 1996 |
| | | Probe | CTCTGTGGCACCCTGGACTACCTG | SEQ ID NO: 1997 |
| | | RPr | TCCGACCTTCAATCATTTCA | SEQ ID NO: 1998 |
| STMN1 | NM_005563.2 | FPr | AATACCCAACGCACAAATGA | SEQ ID NO: 1999 |
| | | Probe | CACGTTCTCTGCCCCGTTTCTTG | SEQ ID NO: 2000 |
| | | RPr | GGAGACAATGCAAACCACAC | SEQ ID NO: 2001 |
| STMY3 | NM_005940.2 | FPr | CCTGGAGGCTGCAACATACC | SEQ ID NO: 2002 |
| | | Probe | ATCCTCCTGAAGCCCTTTTCGCAGC | SEQ ID NO: 2003 |
| | | RPr | TACAATGGCTTTGGAGGATAGCA | SEQ ID NO: 2004 |
| STS | NM_000351.2 | FPr | GAAGATCCCTTTCCTCCTACTGTTC | SEQ ID NO: 2005 |
| | | Probe | CTTCGTGGCTCTCGGCTTCCCA | SEQ ID NO: 2006 |
| | | RPr | GGATGATGTTCGGCCTTGAT | SEQ ID NO: 2007 |
| SURV | NM_001168.1 | FPr | TGTTTTGATTCCCGGGCTTA | SEQ ID NO: 2008 |
| | | Probe | TGCCTTCTTCCTCCCTCACTTCTCACCT | SEQ ID NO: 2009 |
| | | RPr | CAAAGCTGTCAGCTCTAGCAAAG | SEQ ID NO: 2010 |
| TAGLN | NM_003186.2 | FPr | GATGGAGCAGGTGGCTCAGT | SEQ ID NO: 2011 |
| | | Probe | CCCAGAGTCCTCAGCCGCCTTCAG | SEQ ID NO: 2012 |
| | | RPr | AGTCTGGAACATGTCAGTCTTGATG | SEQ ID NO: 2013 |
| TBP | NM_003194.1 | FPr | GCCCGAAACGCCGAATATA | SEQ ID NO: 2014 |
| | | Probe | TACCGCAGCAAACCGCTTGGG | SEQ ID NO: 2015 |
| | | RPr | CGTGGCTCTCTTATCCTCATGAT | SEQ ID NO: 2016 |
| TCF-1 | NM_000545.3 | FPr | GAGGTCCTGAGCACTGCC | SEQ ID NO: 2017 |
| | | Probe | CTGGGTTCACAGGTCCTTTGTCC | SEQ ID NO: 2018 |
| | | RPr | GATGTGGGACCATGCTTGT | SEQ ID NO: 2019 |
| TCF-7 | NM_003202.2 | FPr | GCAGCTGCAGTCAACAGTTC | SEQ ID NO: 2020 |
| | | Probe | AAGTCATGGCCCAAATCCAGTGTG | SEQ ID NO: 2021 |
| | | RPr | CTGTGAATGGGAGGGGT | SEQ ID NO: 2022 |
| TCF7L1 | NM_031283.1 | FPr | CCGGGACACTTTCCAGAAG | SEQ ID NO: 2023 |
| | | Probe | TCTCACTTCGGCGAAATAGTCCCG | SEQ ID NO: 2024 |
| | | RPr | AGAACGCGCTGTCCTGAG | SEQ ID NO: 2025 |
| TCF7L2 | NM_030756.1 | FPr | CCAATCACGACAGGAGGATT | SEQ ID NO: 2026 |
| | | Probe | AGACACCCCTACCCCACAGCTCTG | SEQ ID NO: 2027 |
| | | RPr | TGGACACGGAAGCATTGAC | SEQ ID NO: 2028 |
| TCFL4 | NM_170607.2 | FPr | CTGACTGCTCTGCTTAAAGGTGAA | SEQ ID NO: 2029 |
| | | Probe | TAGCAGGAACAACAACAAAAGCCAACCAA | SEQ ID NO: 2030 |
| | | RPr | ATGTCTTGCACTGGCTACCTTGT | SEQ ID NO: 2031 |
| TEK | NM_000459.1 | FPr | ACTTCGGTGCTACTTAACAACTTACATC | SEQ ID NO: 2032 |
| | | Probe | AGCTCGGACCACGTACTGCTCCCTG | SEQ ID NO: 2033 |
| | | RPr | CCTGGGCCTTGGTGTTGAC | SEQ ID NO: 2034 |
| TERC | U86046.1 | FPr | AAGAGGAACGGAGCGAGTC | SEQ ID NO: 2035 |
| | | Probe | CACGTCCCACAGCTCAGGGAATC | SEQ ID NO: 2036 |
| | | RPr | ATGTGTGAGCCGAGTCCTG | SEQ ID NO: 2037 |
| TERT | NM_003219.1 | FPr | GACATGGAGAACAAGCTGTTTGC | SEQ ID NO: 2038 |
| | | Probe | ACCAAACGCAGGAGCAGCCCG | SEQ ID NO: 2039 |
| | | RPr | GAGGTGTCACCAACAAGAAATCAT | SEQ ID NO: 2040 |
| TFF3 | NM_003226.1 | FPr | AGGCACTGTTCATCTCAGTTTTCT | SEQ ID NO: 2041 |
| | | Probe | CAGAAAGCTTGCCGGGAGCAAAGG | SEQ ID NO: 2042 |
| | | RPr | CATCAGGCTCCAGATATGAACTTTC | SEQ ID NO: 2043 |
| TGFA | NM_003236.1 | FPr | GGTGTGCCACAGACCTTCCT | SEQ ID NO: 2044 |
| | | Probe | TTGGCCTGTAATCACCTGTGCAGCCTT | SEQ ID NO: 2045 |
| | | RPr | ACGGAGTTCTTGACAGAGTTTTGA | SEQ ID NO: 2046 |
| TGFB2 | NM_003238.1 | FPr | ACCAGTCCCCCAGAAGACTA | SEQ ID NO: 2047 |
| | | Probe | TCCTGAGCCCGAGGAAGTCCC | SEQ ID NO: 2048 |
| | | RPr | CCTGGTGCTGTTGTAGATGG | SEQ ID NO: 2049 |
| TGFB3 | NM_003239.1 | FPr | GGATCGAGCTCTTCCAGATCCT | SEQ ID NO: 2050 |
| | | Probe | CGGCCAGATGAGCACATTGCC | SEQ ID NO: 2051 |
| | | RPr | GCCACCGATATAGCGCTGTT | SEQ ID NO: 2052 |

TABLE A-continued

| Gene | Accession | Reagt | Sequence | SEQ ID NO |
|---|---|---|---|---|
| TGFBI | NM_000358.1 | FPr | GCTACGAGTGCTGTCCTGG | SEQ ID NO: 2053 |
| | | Probe | CCTTCTCCCCAGGGACCTTTTCAT | SEQ ID NO: 2054 |
| | | RPr | AGTGGTAGGGCTGCTGGAC | SEQ ID NO: 2055 |
| TGFBR1 | NM_004612.1 | FPr | GTCATCACCTGGCCTTGG | SEQ ID NO: 2056 |
| | | Probe | AGCAATGACAGCTGCCAGTTCCAC | SEQ ID NO: 2057 |
| | | RPr | GCAGACGAAGCACACTGGT | SEQ ID NO: 2058 |
| TGFBR2 | NM_003242.2 | FPr | AACACCAATGGGTTCCATCT | SEQ ID NO: 2059 |
| | | Probe | TTCTGGGCTCCTGATTGCTCAAGC | SEQ ID NO: 2060 |
| | | RPr | CCTCTTCATCAGGCCAAACT | SEQ ID NO: 2061 |
| THBS1 | NM_003246.1 | FPr | CATCCGCAAAGTGACTGAAGAG | SEQ ID NO: 2062 |
| | | Probe | CCAATGAGCTGAGGCGGCCTCC | SEQ ID NO: 2063 |
| | | RPr | GTACTGAACTCCGTTGTGATAGCATAG | SEQ ID NO: 2064 |
| THY1 | NM_006288.2 | FPr | GGACAAGACCCTCTCAGGCT | SEQ ID NO: 2065 |
| | | Probe | CAAGCTCCCAAGAGCTTCCAGAGC | SEQ ID NO: 2066 |
| | | RPr | TTGGAGGCTGTGGGTCAG | SEQ ID NO: 2067 |
| TIMP1 | NM_003254.1 | FPr | TCCCTGCGGTCCCAGATAG | SEQ ID NO: 2068 |
| | | Probe | ATCCTGCCCGGAGTGGAACTGAAGC | SEQ ID NO: 2069 |
| | | RPr | GTGGGAACAGGGTGGACACT | SEQ ID NO: 2070 |
| TIMP2 | NM_003255.2 | FPr | TCACCCTCTGTGACTTCATCGT | SEQ ID NO: 2071 |
| | | Probe | CCCTGGGACACCCTGAGCACCA | SEQ ID NO: 2072 |
| | | RPr | TGTGGTTCAGGCTCTTCTTCTG | SEQ ID NO: 2073 |
| TIMP3 | NM_000362.2 | FPr | CTACCTGCCTTGCTTTGTGA | SEQ ID NO: 2074 |
| | | Probe | CCAAGAACGAGTGTCTCTGGACCG | SEQ ID NO: 2075 |
| | | RPr | ACCGAAATTGGAGAGCATGT | SEQ ID NO: 2076 |
| TJP1 | NM_003257.1 | FPr | ACTTTGCTGGGACAAAGGTC | SEQ ID NO: 2077 |
| | | Probe | CTCGGGCCTGCCCACTTCTTC | SEQ ID NO: 2078 |
| | | RPr | CACATGGACTCCTCAGCATC | SEQ ID NO: 2079 |
| TK1 | NM_003258.1 | FPr | GCCGGGAAGACCGTAATTGT | SEQ ID NO: 2080 |
| | | Probe | CAAATGGCTTCCTCTGGAAGGTCCCA | SEQ ID NO: 2081 |
| | | RPr | CAGCGGCACCAGGTTCAG | SEQ ID NO: 2082 |
| TLN1 | NM_006289.2 | FPr | AAGCAGAAGGGAGAGCGTAAGA | SEQ ID NO: 2083 |
| | | Probe | CTTCCAGGCACACAAGAATTGTGGGC | SEQ ID NO: 2084 |
| | | RPr | CCTTGGCCTCAATCTCACTCA | SEQ ID NO: 2085 |
| TMEPAI | NM_020182.3 | FPr | CAGAAGGATGCCTGTGGC | SEQ ID NO: 2086 |
| | | Probe | ATTCCGTTGCCTGACACTGTGCTC | SEQ ID NO: 2087 |
| | | RPr | GTAGACCTGCGGCTCTGG | SEQ ID NO: 2088 |
| TMSB10 | NM_021103.2 | FPr | GAAATCGCCAGCTTCGATAA | SEQ ID NO: 2089 |
| | | Probe | CGTCTCCGTTTTCTTCAGCTTGGC | SEQ ID NO: 2090 |
| | | RPr | GTCGGCAGGGTGTTCTTTT | SEQ ID NO: 2091 |
| TMSB4X | NM_021109.2 | FPr | CACATCAAAGAACTACTGACAACGAA | SEQ ID NO: 2092 |
| | | Probe | CCGCGCCTGCCTTTCCCA | SEQ ID NO: 2093 |
| | | RPr | CCTGCCAGCCAGATAGATAGACA | SEQ ID NO: 2094 |
| TNC | NM_002160.1 | FPr | AGCTCGGAACCTCACCGT | SEQ ID NO: 2095 |
| | | Probe | CAGCCTTCGGGCTGTGGACATAC | SEQ ID NO: 2096 |
| | | RPr | GTAGCAGCCTTGAGGCCC | SEQ ID NO: 2097 |
| TNF | NM_000594.1 | FPr | GGAGAAGGGTGACCGACTCA | SEQ ID NO: 2098 |
| | | Probe | CGCTGAGATCAATCGGCCCGACTA | SEQ ID NO: 2099 |
| | | RPr | TGCCCAGACTCGGCAAAG | SEQ ID NO: 2100 |
| TNFRSF5 | NM_001250.3 | FPr | TCTCACCTCGCTATGGTTCGT | SEQ ID NO: 2101 |
| | | Probe | TGCCTCTGCAGTGCGTCCTCTGG | SEQ ID NO: 2102 |
| | | RPr | GATGGACAGCGGTCAGCAA | SEQ ID NO: 2103 |
| TNFRSF6B | NM_003823.2 | FPr | CCTCAGCACCAGGGTACCA | SEQ ID NO: 2104 |
| | | Probe | TGACGGCACGCTCACACTCCTCAG | SEQ ID NO: 2105 |
| | | RPr | TGTCCTGGAAAGCCACAAAGT | SEQ ID NO: 2106 |
| TNFSF4 | NM_003326.2 | FPr | CTTCATCTTCCCTCTACCCAGA | SEQ ID NO: 2107 |
| | | Probe | CAGGGGTTGGACCCTTTCCATCTT | SEQ ID NO: 2108 |
| | | RPr | GCTGCATTTCCCACATTCTC | SEQ ID NO: 2109 |

TABLE A-continued

| Gene | Accession | Reagt | Sequence | SEQ ID NO |
|---|---|---|---|---|
| TOP2A | NM_001067.1 | FPr | AATCCAAGGGGGAGAGTGAT | SEQ ID NO: 2110 |
| | | Probe | CATATGGACTTTGACTCAGCTGTGGC | SEQ ID NO: 2111 |
| | | RPr | GTACAGATTTTGCCCGAGGA | SEQ ID NO: 2112 |
| TOP2B | NM_001068.1 | FPr | TGTGGACATCTTCCCCTCAGA | SEQ ID NO: 2113 |
| | | Probe | TTCCCTACTGAGCCACCTTCTCTG | SEQ ID NO: 2114 |
| | | RPr | CTAGCCCGACCGGTTCGT | SEQ ID NO: 2115 |
| TP | NM_001953.2 | FPr | CTATATGCAGCCAGAGATGTGACA | SEQ ID NO: 2116 |
| | | Probe | ACAGCCTGCCACTCATCACAGCC | SEQ ID NO: 2117 |
| | | RPr | CCACGAGTTTCTTACTGAGAATGG | SEQ ID NO: 2118 |
| TP53BP1 | NM_005657.1 | FPr | TGCTGTTGCTGAGTCTGTTG | SEQ ID NO: 2119 |
| | | Probe | CCAGTCCCCAGAAGACCATGTCTG | SEQ ID NO: 2120 |
| | | RPr | CTTGCCTGGCTTCACAGATA | SEQ ID NO: 2121 |
| TP53BP2 | NM_005426.1 | FPr | GGGCCAAATATTCAGAAGC | SEQ ID NO: 2122 |
| | | Probe | CCACCATAGCGGCCATGGAG | SEQ ID NO: 2123 |
| | | RPr | GGATGGGTATGATGGGACAG | SEQ ID NO: 2124 |
| TP53I3 | NM_004881.2 | FPr | GCGGACTTAATGCAGAGACA | SEQ ID NO: 2125 |
| | | Probe | CAGTATGACCCACCTCCAGGAGCC | SEQ ID NO: 2126 |
| | | RPr | TCAAGTCCCAAAATGTTGCT | SEQ ID NO: 2127 |
| TRAG3 | NM_004909.1 | FPr | GACGCTGGTCTGGTGAAGATG | SEQ ID NO: 2128 |
| | | Probe | CCAGGAAACCACGAGCCTCCAGC | SEQ ID NO: 2129 |
| | | RPr | TGGGTGGTTGTTGGACAATG | SEQ ID NO: 2130 |
| TRAIL | NM_003810.1 | FPr | CTTCACAGTGCTCCTGCAGTCT | SEQ ID NO: 2131 |
| | | Probe | AAGTACACGTAAGTTACAGCCACACA | SEQ ID NO: 2132 |
| | | RPr | CATCTGCTTCAGCTCGTTGGT | SEQ ID NO: 2133 |
| TS | NM_001071.1 | FPr | GCCTCGGTGTGCCTTTCA | SEQ ID NO: 2134 |
| | | Probe | CATCGCCAGCTACGCCCTGCTC | SEQ ID NO: 2135 |
| | | RPr | CGTGATGTGCGCAATCATG | SEQ ID NO: 2136 |
| TST | NM_003312.4 | FPr | GGAGCCGGATGCAGTAGGA | SEQ ID NO: 2137 |
| | | Probe | ACCACGGATATGGCCCGAGTCCA | SEQ ID NO: 2138 |
| | | RPr | AAGTCCATGAAAGGCATGTTGA | SEQ ID NO: 2139 |
| TUBA1 | NM_006000.1 | FPr | TGTCACCCCGACTCAACGT | SEQ ID NO: 2140 |
| | | Probe | AGACGCACCGCCCGGACTCAC | SEQ ID NO: 2141 |
| | | RPr | ACGTGGACTGAGATGCATTCAC | SEQ ID NO: 2142 |
| TUBB | NM_001069.1 | FPr | CGAGGACGAGGCTTAAAAAC | SEQ ID NO: 2143 |
| | | Probe | TCTCAGATCAATCGTGCATCCTTAGTGAA | SEQ ID NO: 2144 |
| | | RPr | ACCATGCTTGAGGACAACAG | SEQ ID NO: 2145 |
| TUFM | NM_003321.3 | FPr | GTATCACCATCAATGCGGC | SEQ ID NO: 2146 |
| | | Probe | CATGTGGAGTATAGCACTGCCGCC | SEQ ID NO: 2147 |
| | | RPr | CAGTCTGTGTGGGCGTAGTG | SEQ ID NO: 2148 |
| TULP3 | NM_003324.2 | FPr | TGTGTATAGTCCTGCCCCTCAA | SEQ ID NO: 2149 |
| | | Probe | CCGGATTATCCGACATCTTACTGTGA | SEQ ID NO: 2150 |
| | | RPr | CCCGATCCATTCCCCTTTTA | SEQ ID NO: 2151 |
| tusc4 | NM_006545.4 | FPr | GGAGGAGCTAAATGCCTCAG | SEQ ID NO: 2152 |
| | | Probe | ACTCATCAATGGGCAGAGTGCACC | SEQ ID NO: 2153 |
| | | RPr | CCTTCAAGTGGATGGTGTTG | SEQ ID NO: 2154 |
| UBB | NM_018955.1 | FPr | GAGTCGACCCTGCACCTG | SEQ ID NO: 2155 |
| | | Probe | AATTAACAGCCACCCTCAGGCG | SEQ ID NO: 2156 |
| | | RPr | GCGAATGCCATGACTGAA | SEQ ID NO: 2157 |
| UBC | NM_021009.2 | FPr | ACGCACCCTGTCTGACTACA | SEQ ID NO: 2158 |
| | | Probe | CATCCAGAAAGAGTCCACCCTGCA | SEQ ID NO: 2159 |
| | | RPr | ACCTCTAAGACGGAGCACCA | SEQ ID NO: 2160 |
| UBE2C | NM_007019.2 | FPr | TGTCTGGCGATAAAGGGATT | SEQ ID NO: 2161 |
| | | Probe | TCTGCCTTCCCTGAATCAGACAACC | SEQ ID NO: 2162 |
| | | RPr | ATGGTCCCTACCCATTTGAA | SEQ ID NO: 2163 |
| UBE2M | NM_003969.1 | FPr | CTCCATAATTTATGGCCTGCAGTA | SEQ ID NO: 2164 |
| | | Probe | TCTTCTTGGAGCCCAACCCCGAG | SEQ ID NO: 2165 |
| | | RPr | TGCGGCCTCCTTGTTCAG | SEQ ID NO: 2166 |

TABLE A-continued

| Gene | Accession | Reagt | Sequence | SEQ ID NO |
|---|---|---|---|---|
| UBL1 | NM_003352.3 | FPr | GTGAAGCCACCGTCATCATG | SEQ ID NO: 2167 |
| | | Probe | CTGACCAGGAGGCAAAACCTTCAACTGA | SEQ ID NO: 2168 |
| | | RPr | CCTTCCTTCTTATCCCCCAAGT | SEQ ID NO: 2169 |
| UCP2 | NM_003355.2 | FPr | ACCATGCTCCAGAAGGAGG | SEQ ID NO: 2170 |
| | | Probe | CCCCGAGCCTTCTACAAAGGGTTC | SEQ ID NO: 2171 |
| | | RPr | AACCCAAGCGGAGAAAGG | SEQ ID NO: 2172 |
| UGT1A1 | NM_000463.2 | FPr | CCATGCAGCCTGGAATTTG | SEQ ID NO: 2173 |
| | | Probe | CTACCCAGTGCCCCAACCCATTCTC | SEQ ID NO: 2174 |
| | | RPr | GAGAGGCCTGGGCACGTA | SEQ ID NO: 2175 |
| UMPS | NM_000373.1 | FPr | TGCGGAAATGAGCTCCAC | SEQ ID NO: 2176 |
| | | Probe | CCCTGGCCACTGGGGACTACACTA | SEQ ID NO: 2177 |
| | | RPr | CCTCAGCCATTCTAACCGC | SEQ ID NO: 2178 |
| UNC5A | XM_030300.7 | FPr | GACAGCTGATCCAGGAGCC | SEQ ID NO: 2179 |
| | | Probe | CGGGTCCTGCACTTCAAGGACAGT | SEQ ID NO: 2180 |
| | | RPr | ATGGATAGGCGCAGGTTG | SEQ ID NO: 2181 |
| UNC5B | NM_170744.2 | FPr | AGAACGGAGGCCGTGACT | SEQ ID NO: 2182 |
| | | Probe | CGGGACGCTGCTCGACTCTAAGAA | SEQ ID NO: 2183 |
| | | RPr | CATGCACAGCCCATCTGT | SEQ ID NO: 2184 |
| UNC5C | NM_003728.2 | FPr | CTGAACACAGTGGAGCTGGT | SEQ ID NO: 2185 |
| | | Probe | ACCTGCCGCACACAGAGTTTGC | SEQ ID NO: 2186 |
| | | RPr | CTGGAAGATCTGCCCTTCTC | SEQ ID NO: 2187 |
| upa | NM_002658.1 | FPr | GTGGATGTGCCCTGAAGGA | SEQ ID NO: 2188 |
| | | Probe | AAGCCAGGCGTCTACACGAGAGTCTCAC | SEQ ID NO: 2189 |
| | | RPr | CTGCGGATCCAGGGTAAGAA | SEQ ID NO: 2190 |
| UPP1 | NM_003364.2 | FPr | ACGGGTCCTGCCTCAGTT | SEQ ID NO: 2191 |
| | | Probe | TCAGCTTTCTCTGCATTGGCTCCC | SEQ ID NO: 2192 |
| | | RPr | CGGGGCAATCATTGTGAC | SEQ ID NO: 2193 |
| VCAM1 | NM_001078.2 | FPr | TGGCTTCAGGAGCTGAATACC | SEQ ID NO: 2194 |
| | | Probe | CAGGCACACACAGGTGGGACACAAAT | SEQ ID NO: 2195 |
| | | RPr | TGCTGTCGTGATGAGAAAATAGTG | SEQ ID NO: 2196 |
| VCL | NM_003373.2 | FPr | GATACCACAACTCCCATCAAGCT | SEQ ID NO: 2197 |
| | | Probe | AGTGGCAGCCACGGCGCC | SEQ ID NO: 2198 |
| | | RPr | TCCCTGTTAGGCGCATCAG | SEQ ID NO: 2199 |
| VCP | NM_007126.2 | FPr | GGCTTTGGCAGCTTCAGAT | SEQ ID NO: 2200 |
| | | Probe | AGCTCCACCCTGGTTCCTGAAG | SEQ ID NO: 2201 |
| | | RPr | CTCCACTGCCCTGACTGG | SEQ ID NO: 2202 |
| VDAC1 | NM_003374.1 | FPr | GCTGCGACATGGATTTCGA | SEQ ID NO: 2203 |
| | | Probe | TTGCTGGGCCTTCCATCCGG | SEQ ID NO: 2204 |
| | | RPr | CCAGCCCTCGTAACCTAGCA | SEQ ID NO: 2205 |
| VDAC2 | NM_003375.2 | FPr | ACCCACGGACAGACTTGC | SEQ ID NO: 2206 |
| | | Probe | CGCGTCCAATGTGTATTCCTCCAT | SEQ ID NO: 2207 |
| | | RPr | AGCTTTGCCAAGGTCAGC | SEQ ID NO: 2208 |
| VDR | NM_000376.1 | FPr | GCCCTGGATTTCAGAAAGAG | SEQ ID NO: 2209 |
| | | Probe | CAAGTCTGGATCTGGGACCCTTTCC | SEQ ID NO: 2210 |
| | | RPr | AGTTACAAGCCAGGGAAGGA | SEQ ID NO: 2211 |
| VEGF | NM_003376.3 | FPr | CTGCTGTCTTGGGTGCATTG | SEQ ID NO: 2212 |
| | | Probe | TTGCCTTGCTGCTCTACCTCCACCA | SEQ ID NO: 2213 |
| | | RPr | GCAGCCTGGGACCACTTG | SEQ ID NO: 2214 |
| VEGF_altsplice1 | AF486837.1 | FPr | TGTGAATGCAGACCAAAGAAAGA | SEQ ID NO: 2215 |
| | | Probe | AGAGCAAGACAAGAAAATCCCTGTGGGC | SEQ ID NO: 2216 |
| | | RPr | GCTTTCTCCGCTCTGAGCAA | SEQ ID NO: 2217 |
| VEGF_altsplice2 | AF214570.1 | FPr | AGCTTCCTACAGCACAACAAAT | SEQ ID NO: 2218 |
| | | Probe | TGTCTTGCTCTATCTTTCTTTGGTCTGCA | SEQ ID NO: 2219 |
| | | RPr | CTCGGCTTGTCACATTTTTC | SEQ ID NO: 2220 |
| VEGFB | NM_003377.2 | FPr | TGACGATGGCCTGGAGTGT | SEQ ID NO: 2221 |
| | | Probe | CTGGGCAGCACCAAGTCCGGA | SEQ ID NO: 2222 |
| | | RPr | GGTACCGGATCATGAGGATCTG | SEQ ID NO: 2223 |

TABLE A-continued

| Gene | Accession | Reagt | Sequence | SEQ ID NO |
|---|---|---|---|---|
| VEGFC | NM_005429.2 | FPr | CCTCAGCAAGACGTTATTTGAAATT | SEQ ID NO: 2224 |
| | | Probe | CCTCTCTCTCAAGGCCCCAAACCAGT | SEQ ID NO: 2225 |
| | | RPr | AAGTGTGATTGGCAAAACTGATTG | SEQ ID NO: 2226 |
| VIM | NM_003380.1 | FPr | TGCCCTTAAAGGAACCAATGA | SEQ ID NO: 2227 |
| | | Probe | ATTTCACGCATCTGGCGTTCCA | SEQ ID NO: 2228 |
| | | RPr | GCTTCAACGGCAAAGTTCTCTT | SEQ ID NO: 2229 |
| WIF | NM_007191.2 | FPr | TACAAGCTGAGTGCCCAGG | SEQ ID NO: 2230 |
| | | Probe | TACAAAAGCCTCCATTTCGGCACC | SEQ ID NO: 2231 |
| | | RPr | CACTCGCAGATGCGTCTTT | SEQ ID NO: 2232 |
| WISP1 | NM_003882.2 | FPr | AGAGGCATCCATGAACTTCACA | SEQ ID NO: 2233 |
| | | Probe | CGGGCTGCATCAGCACACGC | SEQ ID NO: 2234 |
| | | RPr | CAAACTCCACAGTACTTGGGTTGA | SEQ ID NO: 2235 |
| Wnt-3a | NM_033131.2 | FPr | ACAAAGCTACCAGGGAGTCG | SEQ ID NO: 2236 |
| | | Probe | TTTGTCCACGCCATTGCCTCAG | SEQ ID NO: 2237 |
| | | RPr | TGAGCGTGTCACTGCAAAG | SEQ ID NO: 2238 |
| Wnt-5a | NM_003392.2 | FPr | GTATCAGGACCACATGCAGTACATC | SEQ ID NO: 2239 |
| | | Probe | TTGATGCCTGTCTTCGCGCCTTCT | SEQ ID NO: 2240 |
| | | RPr | TGTCGGAATTGATACTGGCATT | SEQ ID NO: 2241 |
| Wnt-5b | NM_032642.2 | FPr | TGTCTTCAGGGTCTTGTCCA | SEQ ID NO: 2242 |
| | | Probe | TTCCGTAAGAGGCCTGGTGCTCTC | SEQ ID NO: 2243 |
| | | RPr | GTGCACGTGGATGAAAGAGT | SEQ ID NO: 2244 |
| WNT2 | NM_003391.1 | FPr | CGGTGGAATCTGGCTCTG | SEQ ID NO: 2245 |
| | | Probe | CTCCCTCTGCTCTTGACCTGGCTC | SEQ ID NO: 2246 |
| | | RPr | CCATGAAGAGTTGACCTCGG | SEQ ID NO: 2247 |
| WWOX | NM_016373.1 | FPr | ATCGCAGCTGGTGGGTGTA | SEQ ID NO: 2248 |
| | | Probe | CTGCTGTTTACCTTGGCGAGGCCTTT | SEQ ID NO: 2249 |
| | | RPr | AGCTCCCTGTTGCATGGACTT | SEQ ID NO: 2250 |
| XPA | NM_000380.2 | FPr | GGGTAGAGGGAAAAGGGTTC | SEQ ID NO: 2251 |
| | | Probe | CAAAGGCTGAACTGGATTCTTAACCAAGA | SEQ ID NO: 2252 |
| | | RPr | TGCACCACCATTGCTATTATT | SEQ ID NO: 2253 |
| XPC | NM_004628.2 | FPr | GATACATCGTCTGCGAGGAA | SEQ ID NO: 2254 |
| | | Probe | TTCAAAGACGTGCTCCTGACTGCC | SEQ ID NO: 2255 |
| | | RPr | CTTTCAATGACTGCCTGCTC | SEQ ID NO: 2256 |
| XRCC1 | NM_006297.1 | FPr | GGAGATGAAGCCCCCAAG | SEQ ID NO: 2257 |
| | | Probe | AGAAGCAACCCCAGACCAAAACCA | SEQ ID NO: 2258 |
| | | RPr | GTCCAGCTGCCTGAGTGG | SEQ ID NO: 2259 |
| YB-1 | NM_004559.1 | FPr | AGACTGTGGAGTTTGATGTTGTTGA | SEQ ID NO: 2260 |
| | | Probe | TTGCTGCCTCCGCACCCTTTTCT | SEQ ID NO: 2261 |
| | | RPr | GGAACACCACCAGGACCTGTAA | SEQ ID NO: 2262 |
| YWHAH | NM_003405.2 | FPr | CATGGCCTCCGCTATGAA | SEQ ID NO: 2263 |
| | | Probe | AGGTTCATTCAGCTCTGTCACCGC | SEQ ID NO: 2264 |
| | | RPr | GGAGATTTCGATCTTCATTGGA | SEQ ID NO: 2265 |
| zbtb7 | NM_015898.2 | FPr | CTGCGTTCACACCCCAGT | SEQ ID NO: 2266 |
| | | Probe | TCTCTCCAGAACAGCTCGCCCTGT | SEQ ID NO: 2267 |
| | | RPr | CTCAGCCACGACAGATGGT | SEQ ID NO: 2268 |
| ZG16 | NM_152338.1 | FPr | TGCTGAGCCTCCTCTCCTT | SEQ ID NO: 2269 |
| | | Probe | TACTCCTCATCACAGTGCCCCTGC | SEQ ID NO: 2270 |
| | | RPr | GGATGGGGGTTAGTGATAAGG | SEQ ID NO: 2271 |

TABLE B

| Gene | Locus Link | Sequence | SEQ ID NO |
|---|---|---|---|
| A-Catenin | NM_001903.1 | CGTTCCGATCCTCTATACTGCATCCCAGGCATGCCTACAGCACCCTGATGTCGCAGCCTATAAGGCCAACAGGGACCT | SEQ ID NO: 2272 |

TABLE B-continued

| Gene | Locus Link | Sequence | SEQ ID NO |
|---|---|---|---|
| ABCB1 | NM_000927.2 | AAACACCACTGGAGCATTGACTACCAGGCTCGCCAATGATGCTGCTCAAGTTAAAGGGGCT ATAGGTTCCAGGCTTG | SEQ ID NO: 2273 |
| ABCC5 | NM_005688.1 | TGCAGACTGTACCATGCTGACCATTGCCCATCGCCTGCACACGGTTCTAGGCTCCGATAGGA TTATGGTGCTGGCC | SEQ ID NO: 2274 |
| ABCC6 | NM_001171.2 | GGATGAACCTCGACCTGCTGCAGGAGCACTCGGACGAGGCTATCTGGGCAGCCCTGGAGAC GGTGCAGCTC | SEQ ID NO: 2275 |
| ACP1 | NM_004300.2 | GCTACCAAGTCCGTGCTGTTTGTGTGTCTGGGTAACATTTGTCGATCACCCATTGCAGAAGC AGTTTTC | SEQ ID NO: 2276 |
| ADAM10 | NM_001110.1 | CCCATCAACTTGTGCCAGTACAGGGTCTGTGCAGTGGAGTAGGCACTTCAGTGGTCGAACCA TCACC | SEQ ID NO: 2277 |
| ADAM17 | NM_003183.3 | GAAGTGCCAGGAGGCGATTAATGCTACTTGCAAAGGCGTGTCCTACTGCACAGGTAATAGC AGTGAGTGCCCG | SEQ ID NO: 2278 |
| ADAMTS12 | NM_030955.2 | GGAGAAGGGTGGAGTGCAGCACCCAGATGGATTCTGACTGTGCGGCCATCCAGAGACCTGA CCCTG | SEQ ID NO: 2279 |
| ADPRT | NM_001618.2 | TTGACAACCTGCTGGACATCGAGGTGGCCTACAGTCTGCTCAGGGGAGGGTCTGATGATAGC AGCAAGGATCCCAT | SEQ ID NO: 2280 |
| AGXT | NM_000030.1 | CTTTTCCCTCCAGTGGCACCTCCTGGAAACAGTCCACTTGGGCGCAAAACCCAGTGCCTTCC AAAT | SEQ ID NO: 2281 |
| AKAP12 | NM_005100.2 | TAGAGAGCCCCTGACAATCCTGAGGCTTCATCAGGAGCTAGAGCCATTTAACATTTCCTCTT TCCAAGACCAACC | SEQ ID NO: 2282 |
| AKT1 | NM_005163.1 | CGCTTCTATGGCGCTGAGATTGTGTCAGCCCTGGACTACCTGCACTCGGAGAAGAACGTGGT GTACCGGGA | SEQ ID NO: 2283 |
| AKT2 | NM_001626.2 | TCCTGCCACCCTTCAAACCTCAGGTCACGTCCGAGGTCGACACAAGGTACTTCGATGATGAA TTTACCGCC | SEQ ID NO: 2284 |
| AKT3 | NM_005465.1 | TTGTCTCTGCCTTGGACTATCTACATTCCGGAAAGATTGTGTACCGTGATCTCAAGTTGGAGA ATCTAATGCTGG | SEQ ID NO: 2285 |
| AL137428 | AL137428.1 | CAAGAAGAGGCTCTACCCTGGGACTGGGAATTTCCAAGGCCACCTTTGAGGATCGCAGAGC TCATTT | SEQ ID NO: 2286 |
| ALCAM | NM_001627.1 | GAGGAATATGGAATCCAAGGGGCCAGTTCCTGCCGTCTGCTCTTCTGCCTCTTGATCTCCG CCAC | SEQ ID NO: 2287 |
| ALDH1A1 | NM_000689.1 | GAAGGAGATAAGGAGGATGTTGACAAGGCAGTGAAGGCCGCAAGACAGGCTTTTCAGATTG GATCTCCGTGGCG | SEQ ID NO: 2288 |
| ALDOA | NM_000034.2 | GCCTGTACGTGCCAGCTCCCCGACTGCCAGAGCCTCAACTGTCTCTGCTTCGAGATCAAGCT CCGATGA | SEQ ID NO: 2289 |
| AMFR | NM_001144.2 | GATGGTTCAGCTCTGCAAGGATCGATTTGAATATCTTTCCTTCTCGCCCACCACGCCGATGA GCAGCCACGGTCGA | SEQ ID NO: 2290 |
| ANGPT2 | NM_001147.1 | CCGTGAAAGCTGCTCTGTAAAAGCTGACACAGCCCTCCCAAGTGAGCAGGACTGTTCTTCCC ACTGCAA | SEQ ID NO: 2291 |

TABLE B-continued

| Gene | Locus Link | Sequence | SEQ ID NO |
|---|---|---|---|
| ANTXR1 | NM_032208.1 | CTCCAGGTGTACCTCCAACCCTAGCCTTCTCCCACAGCTGCCTACAACAGAGTCTCCCAGCC TTCTC | SEQ ID NO: 2292 |
| ANXA1 | NM_000700.1 | GCCCCTATCCTACCTTCAATCCATCCTCGGATGTCGCTGCCTTGCATAAGGCCATAATGGTTA AAGG | SEQ ID NO: 2293 |
| ANXA2 | NM_004039.1 | CAAGACACTAAGGGCGACTACCAGAAAGCGCTGCTGTACCTGTGTGGTGGAGATGACTGAA GCCCGACACG | SEQ ID NO: 2294 |
| ANXA5 | NM_001154.2 | GCTCAAGCCTGGAAGATGACGTGGTGGGGGACACTTCAGGGTACTACCAGCGGATGTTGGT GGTTCT | SEQ ID NO: 2295 |
| AP-1 (JUN official) | NM_002228.2 | GACTGCAAAGATGGAAACGACCTTCTATGACGATGCCCTCAACGCCTCGTTCCTCCCGTCCG AGAGCGGACCTTATGGCTA | SEQ ID NO: 2296 |
| APC | NM_000038.1 | GGACAGCAGGAATGTGTTTCTCCATACAGGTCACGGGGAGCCAATGGTTCAGAAACAAATC GAGTGGGT | SEQ ID NO: 2297 |
| APEX-1 | NM_001641.2 | GATGAAGCCTTTCGCAAGTTCCTGAAGGGCCTGGCTTCCCGAAAGCCCCTTGTGCTGTGTGG AGACCT | SEQ ID NO: 2298 |
| APG-1 | NM_014278.2 | ACCCCGGCCTGTATATCATTGGGATCAAGAACTCGAGCCATTGGAAATGCAGCAAAGAGCC AGATAG | SEQ ID NO: 2299 |
| APN (ANPEP official) | NM_001150.1 | CCACCTTGGACCAAAGTAAAGCGTGGAATCGTTACCGCCTCCCCAACACGCTGAAACCCGAT TCCTACCAGGTGACGCTGAGA | SEQ ID NO: 2300 |
| APOC1 | NM_001645.3 | GGAAACACACTGGAGGACAAGGCTCGGGAACTCATCAGCCGCATCAAACAGAGTGAACTTT CTGCCAAGATGCG | SEQ ID NO: 2301 |
| AREG | NM_001657.1 | TGTGAGTGAAATGCCTTCTAGTAGTGAACCGTCCTCGGGAGCCGACTATGACTACTCAGAAG AGTATGATAACGAACCACAA | SEQ ID NO: 2302 |
| ARG | NM_005158.2 | CGCAGTGCAGCTGAGTATCTGCTCAGCAGTCTAATCAATGGCAGCTTCCTGGTGCGAGAAAG TGAGAGTAGCCCTGGGCA | SEQ ID NO: 2303 |
| ARHF | NM_019034.2 | ACTGGCCCACTTAGTCCTCAAGCTCCCAACCTGCTGTCCCTCAAGCCCCGCTTCTACCAGCCT GTGGAGTTCAG | SEQ ID NO: 2304 |
| ATOH1 | NM_005172.1 | GCAGCCACCTGCAACTTTGCAGGCGAGAGAGCATCCCGTCTACCCGCCTGAGCTGTCCCTCC TGGA | SEQ ID NO: 2305 |
| ATP5A1 | NM_004046.3 | GATGCTGCCACTCAACAACTTTTGAGTCGTGGCGTGCGTCTAACTGAGTTGCTGAAGCAAGG ACA | SEQ ID NO: 2306 |
| ATP5E | NM_006886.2 | CCGCTTTCGCTACAGCATGGTGGCCTACTGGAGACAGGCTGGACTCAGCTACATCCGATACT CCCA | SEQ ID NO: 2307 |
| AURKB | NM_004217.1 | AGCTGCAGAAGAGCTGCACATTTGACGAGCAGCGAACAGCCACGATCATGGAGGAGTTGGC AGATGC | SEQ ID NO: 2308 |
| Axin 2 | NM_004655.2 | GGCTATGTCTTTGCACCAGCCACCAGCGCCAACGACAGTGAGATATCCAGTGATGCGCTGAC GGAT | SEQ ID NO: 2309 |
| axin1 | NM_003502.2 | CCGTGTGACAGCATCGTTGTGGCGTACTACTTCTGCGGGGAACCCATCCCCTACCGCACCCT GGTGAG | SEQ ID NO: 2310 |

TABLE B-continued

| Gene | Locus Link | Sequence | SEQ ID NO |
|---|---|---|---|
| B-Catenin | NM_001904.1 | GGCTCTTGTGCGTACTGTCCTTCGGGCTGGTGACAGGGAAGACATCACTGAGCCTGCCATCT GTGCTCTTCGTCATCTGA | SEQ ID NO: 2311 |
| BAD | NM_032989.1 | GGGTCAGGTGCCTCGAGATCGGGCTTGGGCCCAGAGCATGTTCCAGATCCCAGAGTTTGAGC CGAGTGAGCAG | SEQ ID NO: 2312 |
| BAG1 | NM_004323.2 | CGTTGTCAGCACTTGGAATACAAGATGGTTGCCGGGTCATGTTAATTGGGAAAAAGAACAG TCCACAGGAAGAGGTTGAAC | SEQ ID NO: 2313 |
| BAG2 | NM_004282.2 | CTAGGGGCAAAAAGCATGACTGCTTTTTCCTGTCTGGCATGGAATCACGCAGTCACCTTGGG CATTTAG | SEQ ID NO: 2314 |
| BAG3 | NM_004281.2 | GAAAGTAAGCCAGGCCCAGTTGGACCAGAACTCCCTCCTGGACACATCCCAATTCAAGTGA TCCGCAAAGAGGT | SEQ ID NO: 2315 |
| Bak | NM_001188.1 | CCATTCCCACCATTCTACCTGAGGCCAGGACGTCTGGGGTGTGGGGATTGGTGGGTCTATGT TCCC | SEQ ID NO: 2316 |
| Bax | NM_004324.1 | CCGCCGTGGACACAGACTCCCCCCGAGAGGTCTTTTTCCGAGTGGCAGCTGACATGTTTTCT GACGGCAA | SEQ ID NO: 2317 |
| BBC3 | NM_014417.1 | CCTGGAGGGTCCTGTACAATCTCATCATGGGACTCCTGCCCTTACCCAGGGGCCACAGAGCC CCCGAGATGGAGCCCAATTAG | SEQ ID NO: 2318 |
| BCAS1 | NM_003657.1 | CCCCGAGACAACGGAGATAAGTGCTGTTGCGGATGCCAACGGAAAGAATCTTGGGAAAGAG GCCAAACCCGAG | SEQ ID NO: 2319 |
| Bcl2 | NM_000633.1 | CAGATGGACCTAGTACCCACTGAGATTTCCACGCCGAAGGACAGCGATGGGAAAAATGCCC TTAAATCATAGG | SEQ ID NO: 2320 |
| BCL2L10 | NM_020396.2 | GCTGGGATGGCTTTTGTCACTTCTTCAGGACCCCCTTTCCACTGGCTTTTTGGAGAAAACAGC TGGTCCAGGC | SEQ ID NO: 2321 |
| BCL2L11 | NM_138621.1 | AATTACCAAGCAGCCGAAGACCACCCACGAATGGTTATCTTACGACTGTTACGTTACATTGT CCGCCTG | SEQ ID NO: 2322 |
| BCL2L12 | NM_138639.1 | AACCCACCCCTGTCTTGGAGCTCCGGGTAGCTCTCAAACTCGAGGCTGCGCACCCCCTTTCC CGTCAGCTGAG | SEQ ID NO: 2323 |
| Bclx | NM_001191.1 | CTTTTGTGGAACTCTATGGGAACAATGCAGCAGCCGAGAGCCGAAAGGGCCAGGAACGCTT CAACCGCTG | SEQ ID NO: 2324 |
| BCRP | NM_004827.1 | TGTACTGGCGAAGAATATTTGGTAAAGCAGGGCATCGATCTCTCACCCTGGGGCTTGTGGAA GAATCACGTGGC | SEQ ID NO: 2325 |
| BFGF | NM_007083.1 | CCAGGAAGAATGCTTAAGATGTGAGTGGATGGATCTCAATGACCTGGCGAAGACTGAAAAT ACAACTCCCATCACCA | SEQ ID NO: 2326 |
| BGN | NM_001711.3 | GAGCTCCGCAAGGATGACTTCAAGGGTCTCCAGCACCTCTACGCCCTCGTCCTGGTGAACAA CAAG | SEQ ID NO: 2327 |
| BID | NM_001196.2 | GGACTGTGAGGTCAACAACGGTTCCAGCCTCAGGGATGAGTGCATCACAAACCTACTGGTG TTTGGCTTCC | SEQ ID NO: 2328 |
| BIK | NM_001197.3 | ATTCCTATGGCTCTGCAATTGTCACCGGTTAACTGTGGCCTGTGCCCAGGAAGAGCCATTCA CTCCTGCC | SEQ ID NO: 2329 |

TABLE B-continued

| Gene | Locus Link | Sequence | SEQ ID NO |
|---|---|---|---|
| BIN1 | NM_004305.1 | CCTGCAAAAGGGAACAAGAGCCCTTCGCCTCCAGATGGCTCCCCTGCCGCCACCCCCGAGATCAGAGTCAACCACG | SEQ ID NO: 2330 |
| BLMH | NM_000386.2 | GGTTGCTGCCTCCATCAAAGATGGAGAGGCTGTGTGGTTTGGCTGTGATGTTGGAAAACACTTCAATAGCAAGCTGG | SEQ ID NO: 2331 |
| BMP2 | NM_001200.1 | ATGTGGACGCTCTTTCAATGGACGTGTCCCCGCGTGCTTCTTAGACGGACTGCGGTCTCCTAAAGGTCGACCATGGT | SEQ ID NO: 2332 |
| BMP4 | NM_001202.2 | GGGCTAGCCATTGAGGTGACTCACCTCCATCAGACTCGGACCCACCAGGGCCAGCATGTCAGGATTAGC | SEQ ID NO: 2333 |
| BMP7 | NM_001719.1 | TCGTGGAACATGACAAGGAATTCTTCCACCCACGCTACCACCATCGAGAGTTCCGGTTTGATCTTTCCA | SEQ ID NO: 2334 |
| BMPR1A | NM_004329.2 | TTGGTTCAGCGAACTATTGCCAAACAGATTCAGATGGTCCGGCAAGTTGGTAAAGGCCGATATGGAGA | SEQ ID NO: 2335 |
| BRAF | NM_004333.1 | CCTTCCGACCAGCAGATGAAGATCATCGAAATCAATTTGGGCAACGAGACCGATCCTCATCAGCTCCCAATGTGCATATAAA | SEQ ID NO: 2336 |
| BRCA1 | NM_007295.1 | TCAGGGGGCTAGAAATCTGTTGCTATGGGCCCTTCACCAACATGCCCACAGATCAACTGGAATGG | SEQ ID NO: 2337 |
| BRCA2 | NM_000059.1 | AGTTCGTGCTTTGCAAGATGGTGCAGAGCTTTATGAAGCAGTGAAGAATGCAGCAGACCCAGCTTACCTT | SEQ ID NO: 2338 |
| BRK | NM_005975.1 | GTGCAGGAAAGGTTCACAAATGTGGAGTGTCTGCGTCCAATACACGCGTGTGCTCCTCTCCTTACTCCATCGTGTGTGC | SEQ ID NO: 2339 |
| BTF3 | NM_001207.2 | CAGTGATCCACTTTAACAACCCTAAAGTTCAGGCATCTCTGGCAGCGAACACTTTCACCATTACAGGCCATGCT | SEQ ID NO: 2340 |
| BTRC | NM_033637.2 | GTTGGGACACAGTTGGTCTGCAGTCGGCCCAGGACGGTCTACTCAGCACAACTGACTGCTTCA | SEQ ID NO: 2341 |
| BUB1 | NM_004336.1 | CCGAGGTTAATCCAGCACGTATGGGGCCAAGTGTAGGCTCCCAGCAGGAACTGAGAGCGCCATGTCTT | SEQ ID NO: 2342 |
| BUB1B | NM_001211.3 | TCAACAGAAGGCTGAACCACTAGAAAGACTACAGTCCCAGCACCGACAATTCCAAGCTCGAGTGTCTCGGCAAACTCTGTTG | SEQ ID NO: 2343 |
| BUB3 | NM_004725.1 | CTGAAGCAGATGGTTCATCATTTCCTGGGCTGTTAAACAAAGCGAGGTTAAGGTTAGACTCTTGGGAATCAGC | SEQ ID NO: 2344 |
| c-abl | NM_005157.2 | CCATCTCGCTGAGATACGAAGGGAGGGTGTACCATTACAGGATCAACACTGCTTCTGATGGCAAGCTCTACGTCT | SEQ ID NO: 2345 |
| c-kit | NM_000222.1 | GAGGCAACTGCTTATGGCTTAATTAAGTCAGATGCGGCCATGACTGTCGCTGTAAAGATGCTCAAGCCGAGTGCC | SEQ ID NO: 2346 |
| c-myb (MYB official) | NM_005375.1 | AACTCAGACTTGGAAATGCCTTCTTTAACTTCCACCCCCCTCATTGGTCACAAATTGACTGTTACAACACCATTTCATAGAGACCAG | SEQ ID NO: 2347 |
| c-Src | NM_005417.3 | TGAGGAGTGGTATTTTGGCAAGATCACCAGACGGGAGTCAGAGCGGTTACTGCTCAATGCAGAGAACCCGAGAG | SEQ ID NO: 2348 |

TABLE B-continued

| Gene | Locus Link | Sequence | SEQ ID NO |
|---|---|---|---|
| C20 orf1 | NM_012112.2 | TCAGCTGTGAGCTGCGGATACCGCCCGGCAATGGGACCTGCTCTTAACCTCAAACCTAGGACCGT | SEQ ID NO: 2349 |
| C20ORF126 | NM_030815.2 | CCAGCACTGCTCGTTACTGTCTGCCTTCAGTGGTCTGAGGTCCCAGTATGAACTGCCGTGAAGTCAA | SEQ ID NO: 2350 |
| C8orf4 | NM_020130.2 | CTACGAGTCAGCCCATCCATCCATGGCTACCACTTCGACACAGCCTCTCGTAAGAAAGCCGTGGGCA | SEQ ID NO: 2351 |
| CA9 | NM_001216.1 | ATCCTAGCCCTGGTTTTTGGCCTCCTTTTTGCTGTCACCAGCGTCGCGTTCCTTGTGCAGATGAGAAGGCAG | SEQ ID NO: 2352 |
| Cad17 | NM_004063.2 | GAAGGCCAAGAACCGAGTCAAATTATATTCCAGTTTAAGGCCAATCCTCCTGCTGTGACTTTTGAACTAACTGGGGA | SEQ ID NO: 2353 |
| CALD1 | NM_004342.4 | CACTAAGGTTTGAGACAGTTCCAGAAAGAACCCAAGCTCAAGACGCAGGACGAGCTCAGTTGTAGAGGGCTAATTCGC | SEQ ID NO: 2354 |
| CAPG | NM_001747.1 | GATTGTCACTGATGGGGAGGAGCCTGCTGAGATGATCCAGGTCCTGGGCCCCAAGCCTGCTCTGAAGG | SEQ ID NO: 2355 |
| CAPN1 | NM_005186.2 | CAAGAAGCTGTACGAGCTCATCATCACCCGCTACTCGGAGCCCGACCTGGCGGTCGACTTTGACAATTTCGTTTGCTGC | SEQ ID NO: 2356 |
| CASP8 | NM_033357.1 | CCTCGGGGATACTGTCTGATCATCAACAATCACAATTTTGCAAAAGCACGGGAGAAAGTGCCCAAACTTC | SEQ ID NO: 2357 |
| CASP9 | NM_001229.2 | TGAATGCCGTGGATTGCACGTGGCCTCTTGAGCAGTGGCTGGTCCAGGGCTAGTGACTTGTGTCCCATGATCCCTGT | SEQ ID NO: 2358 |
| CAT | NM_001752.1 | ATCCATTCGATCTCACCAAGGTTTGGCCTCACAAGGACTACCCTCTCATCCCAGTTGGTAAACTGGTCTTAAACCGGA | SEQ ID NO: 2359 |
| CAV1 | NM_001753.3 | GTGGCTCAACATTGTGTTCCCATTTCAGCTGATCAGTGGGCCTCCAAGGAGGGGCTGTAAAATGGAGGCCATTG | SEQ ID NO: 2360 |
| CBL | NM_005188.1 | TCATTCACAAACCTGGCAGTTATATCTTCCGGCTGAGCTGTACTCGTCTGGGTCAGTGGGCTATTGGGTATG | SEQ ID NO: 2361 |
| CCL20 | NM_004591.1 | CCATGTGCTGTACCAAGAGTTTGCTCCTGGCTGCTTTGATGTCAGTGCTGCTACTCCACCTCTGCGGCG | SEQ ID NO: 2362 |
| CCL3 | NM_002983.1 | AGCAGACAGTGGTCAGTCCTTTCTTGGCTCTGCTGACACTCGAGCCCACATTCCGTCACCTGCTCAGAATCATGCAG | SEQ ID NO: 2363 |
| CCNA2 | NM_001237.2 | CCATACCTCAAGTATTTGCCATCAGTTATTGCTGGAGCTGCCTTTCATTTAGCACTCTACACAGTCACGGGACAAAGCT | SEQ ID NO: 2364 |
| CCNB1 | NM_031966.1 | TTCAGGTTGTTGCAGGAGACCATGTACATGACTGTCTCCATTATTGATCGGTTCATGCAGAATAATTGTGTGCCCAAGAAGATG | SEQ ID NO: 2365 |
| CCNB2 | NM_004701.2 | AGGCTTCTGCAGGAGACTCTGTACATGTGCGTTGGCATTATGGATCGATTTTTACAGGTTCAGCCAGTTTCCC | SEQ ID NO: 2366 |
| CCND1 | NM_001758.1 | GCATGTTCGTGGCCTCTAAGATGAAGGAGACCATCCCCCTGACGGCCGAGAAGCTGTGCATCTACACCG | SEQ ID NO: 2367 |

TABLE B-continued

| Gene | Locus Link | Sequence | SEQ ID NO |
|---|---|---|---|
| CCND3 | NM_001760.2 | CCTCTGTGCTACAGATTATACCTTTGCCATGTACCCGCCATCCATGATCGCCACGGGCAGCA TTGGGGCTGCAGTG | SEQ ID NO: 2368 |
| CCNE1 | NM_001238.1 | AAAGAAGATGATGACCGGGTTTACCCAAACTCAACGTGCAAGCCTCGGATTATTGCACCATC CAGAGGCTC | SEQ ID NO: 2369 |
| CCNE2 | NM_057749.1 | ATGCTGTGGCTCCTTCCTAACTGGGGCTTTCTTGACATGTAGGTTGCTTGGTAATAACCTTTT TGTATATCACAATTTGGGT | SEQ ID NO: 2370 |
| CCNE2 variant 1 | NM_057749var1 | GGTCACCAAGAAACATCAGTATGAAATTAGGAATTGTTGGCCACCTGTATTATCTGGGGGA TCAGTCCTTGCATTATCATTGAA | SEQ ID NO: 2371 |
| CCR7 | NM_001838.2 | GGATGACATGCACTCAGCTCTTGGCTCCACTGGGATGGGAGGAGAGGACAAGGGAAATGTC AGG | SEQ ID NO: 2372 |
| CD105 | NM_000118.1 | GCAGGTGTCAGCAAGTATGATCAGCAATGAGGCGGTGGTCAATATCCTGTCGAGCTCATCAC CACAGCGGAAAAA | SEQ ID NO: 2373 |
| CD134 (TNFRSF4 official) | NM_003327.1 | GCCCAGTGCGGAGAACAGGTCCAGCTTGATTCTCGTCTCTGCACTTAAGCTGTTCTCCAGGT GCGTGTGATT | SEQ ID NO: 2374 |
| CD18 | NM_000211.1 | CGTCAGGACCCACCATGTCTGCCCCATCACGCGGCCGAGACATGGCTTGGCCACAGCTCTTG AGGATGTCACCAATTAACC | SEQ ID NO: 2375 |
| CD24 | NM_013230.1 | TCCAACTAATGCCACCACCAAGGCGGCTGGTGGTGCCCTGCAGTCAACAGCCAGTCTCTTCG TGGTCTCACTCTCTC | SEQ ID NO: 2376 |
| CD28 | NM_006139.1 | TGTGAAAGGGAAACACCTTTGTCCAAGTCCCCTATTTCCCGGACCTTCTAAGCCCTTTTGGGT GCT | SEQ ID NO: 2377 |
| CD31 | NM_000442.1 | TGTATTTCAAGACCTCTGTGCACTTATTTATGAACCTGCCCTGCTCCCACAGAACACAGCAAT TCCTCAGGCTAA | SEQ ID NO: 2378 |
| CD34 | NM_001773.1 | CCACTGCACACACCTCAGAGGCTGTTCTTGGGGCCCTACACCTTGAGGAGGGGCAGGTAAA CTCCTG | SEQ ID NO: 2379 |
| CD3z | NM_000734.1 | AGATGAAGTGGAAGGCGCTTTTCACCGCGGCCATCCTGCAGGCACAGTTGCCGATTACAGA GGCA | SEQ ID NO: 2380 |
| CD44E | X55150 | ATCACCGACAGCACAGACAGAATCCCTGCTACCAATATGGACTCCAGTCATAGTACAACGCT TCAGCCTACTGCAAATCCAAACACAGGT | SEQ ID NO: 2381 |
| CD44s | M59040.1 | GACGAAGACAGTCCCTGGATCACCGACAGCACAGACAGAATCCCTGCTACCAGAGACCAAG ACACATTCCACCCCAGT | SEQ ID NO: 2382 |
| CD44v3 | AJ251595v3 | CACACAAAACAGAACCAGGACTGGACCCAGTGGAACCCAAGCCATTCAAATCCGGAAGTGC TACTTCAG | SEQ ID NO: 2383 |
| CD44v6 | AJ251595v6 | CTCATACCAGCCATCCAATGCAAGGAAGGACAACACCAAGCCCAGAGGACAGTTCCTGGAC TGATTTCTTCAACCCAA | SEQ ID NO: 2384 |
| CD68 | NM_001251.1 | TGGTTCCCAGCCCTGTGTCCACCTCCAAGCCCAGATTCAGATTCGAGTCATGTACACAACCC AGGGTGGAGGAG | SEQ ID NO: 2385 |
| CD80 | NM_005191.2 | TTCAGTTGCTTTGCAGGAAGTGTCTAGAGGAATATGGTGGGCACAGAAGTAGCTCTGGTGAC CTTGATCAA | SEQ ID NO: 2386 |

TABLE B-continued

| Gene | Locus Link | Sequence | SEQ ID NO |
|---|---|---|---|
| CD82 | NM_002231.2 | GTGCAGGCTCAGGTGAAGTGCTGCGGCTGGGTCAGCTTCTACAACTGGACAGACAACGCTG AGCTCATGAATCGCCCTGAGGTC | SEQ ID NO: 2387 |
| CD8A | NM_171827.1 | AGGGTGAGGTGCTTGAGTCTCCAACGGCAAGGGAACAAGTACTTCTTGATACCTGGGATACT GTGCCC | SEQ ID NO: 2388 |
| CD9 | NM_001769.1 | GGGCGTGGAACAGTTTATCTCAGACATCTGCCCCAAGAAGGACGTACTCGAAACCTTCACCG TG | SEQ ID NO: 2389 |
| CDC2 | NM_001786.2 | GAGAGCGACGCGGTTGTTGTAGCTGCCGCTGCGGCCGCCGCGGAATAATAAGCCGGGATCT ACCATAC | SEQ ID NO: 2390 |
| CDC20 | NM_001255.1 | TGGATTGGAGTTCTGGGAATGTACTGGCCGTGGCACTGGACAACAGTGTGTACCTGTGGAGT GCAAGC | SEQ ID NO: 2391 |
| cdc25A | NM_001789.1 | TCTTGCTGGCTACGCCTCTTCTGTCCCTGTTAGACGTCCTCCGTCCATATCAGAACTGTGCCA CAATGCAG | SEQ ID NO: 2392 |
| CDC25B | NM_021874.1 | AAACGAGCAGTTTGCCATCAGACGCTTCCAGTCTATGCCGGTGAGGCTGCTGGGCCACAGCC CCGTGCTTCGGAACATCACCAAC | SEQ ID NO: 2393 |
| CDC25C | NM_001790.2 | GGTGAGCAGAAGTGGCCTATATCGCTCCCCGTCGATGCCAGAGAACTTGAACAGGCCAAGA CTGAAG | SEQ ID NO: 2394 |
| CDC4 | NM_018315.2 | GCAGTCCGCTGTGTTCAATATGATGGCAGGAGGGTTGTTAGTGGAGCATATGATTTTATGGT AAAGGTGTGGGATCC | SEQ ID NO: 2395 |
| CDC42 | NM_001791.2 | TCCAGAGACTGCTGAAAAGCTGGCCCGTGACCTGAAGGCTGTCAAGTATGTGGAGTGTTCTG CACTTACACA | SEQ ID NO: 2396 |
| CDC42BPA | NM_003607.2 | GAGCTGAAAGACGCACACTGTCAGAGGAAACTGGCCATGCAGGAATTCATGGAGATCAATG AGCGGC | SEQ ID NO: 2397 |
| CDC6 | NM_001254.2 | GCAACACTCCCCATTTACCTCCTTGTTCTCCACCAAAGCAAGGCAAGAAAGAGAATGGTCCC CCTCA | SEQ ID NO: 2398 |
| CDCA7 v2 | NM_145810.1 | AAGACCGTGGATGGCTACATGAATGAAGATGACCTGCCCAGAAGCCGTCGCTCCAGATCAT CCGTGACCCT | SEQ ID NO: 2399 |
| CDH1 | NM_004360.2 | TGAGTGTCCCCCGGTATCTTCCCCGCCCTGCCAATCCCGATGAAATTGGAAATTTTATTGATG AAAATCTGAAAGCGGCTG | SEQ ID NO: 2400 |
| CDH11 | NM_001797.2 | GTCGGCAGAAGCAGGACTTGTACCTTCTGCCCATAGTGATCAGCGATGGCGGCATCCCGCCC ATGAGTAG | SEQ ID NO: 2401 |
| CDH3 | NM_001793.3 | ACCCATGTACCGTCCTCGGCCAGCCAACCCAGATGAAATCGGCAACTTTATAATTGAGAACC TGAAGGCGG | SEQ ID NO: 2402 |
| CDK2 | NM_001798.2 | AATGCTGCACTACGACCCTAACAAGCGGATTTCGGCCAAGGCAGCCCTGGCTCACCCTTTCT TCCAGGATGTGACCAA | SEQ ID NO: 2403 |
| CDX1 | NM_001804.1 | AGCAACACCAGCCTCCTGGCCACCTCCTCTCCAATGCCTGTGAAAGAGGAGTTTCTGCCATA GCCC | SEQ ID NO: 2404 |
| Cdx2 | NM_001265.2 | GGGCAGGCAAGGTTTACACTGCGGAAGCCAAAGGCAGCTAAGATAGAAAGCTGGACTGACC AAAGAC | SEQ ID NO: 2405 |

TABLE B-continued

| Gene | Locus Link | Sequence | SEQ ID NO |
|---|---|---|---|
| CEACAM1 | NM_001712.2 | ACTTGCCTGTTCAGAGCACTCATTCCTTCCCACCCCCAGTCCTGTCCTATCACTCTAATTCGG ATTTGCCA | SEQ ID NO: 2406 |
| CEACAM6 | NM_002483.2 | CACAGCCTCACTTCTAACCTTCTGGAACCCACCCACCACTGCCAAGCTCACTATTGAATCCA CGCCATTCAA | SEQ ID NO: 2407 |
| CEBPB | NM_005194.2 | GCAACCCACGTGTAACTGTCAGCCGGGCCCTGAGTAATCGCTTAAAGATGTTCCTACGGGCT TGT | SEQ ID NO: 2408 |
| CEGP1 | NM_020974.1 | TGACAATCAGCACACCTGCATTCACCGCTCGGAAGAGGGCCTGAGCTGCATGAATAAGGAT CACGGCTGTAGTCACA | SEQ ID NO: 2409 |
| CENPA | NM_001809.2 | TAAATTCACTCGTGGTGTGGACTTCAATTGGCAAGCCCAGGCCCTATTGGCCCTACAAGAGGC | SEQ ID NO: 2410 |
| CENPE | NM_001813.1 | GGATGCTGGTGACCTCTTCTTCCCTCACGTTGCAACAGGAATTAAAGGCTAAAAGAAAACGA AGAGTTACTTGGTGCCTTGGC | SEQ ID NO: 2411 |
| CENPF | NM_016343.2 | CTCCCGTCAACAGCGTTCTTTCCAAACACTGGACCAGGAGTGCATCCAGATGAAGGCCAGAC TCACCC | SEQ ID NO: 2412 |
| CES2 | NM_003869.4 | ACTTTGCGAGAAATGGGAACCCCAATGGCGAGGGTCTGCCACACTGGCCGCTGTTCGACCA GGAGGAGCAATACCTG | SEQ ID NO: 2413 |
| CGA (CHGA official) | NM_001275.2 | CTGAAGGAGCTCCAAGACCTCGCTCTCCAAGGCGCCAAGGAGAGGGCACATCAGCAGAAGA AACACAGCGGTTTTG | SEQ ID NO: 2414 |
| CGB | NM_000737.2 | CCACCATAGGCAGAGGCAGGCCTTCCTACACCCTACTCCCTGTGCCTCCAGCCTCGACTAGT CCCTAGCACTCGACGACT | SEQ ID NO: 2415 |
| CHAF1B | NM_005441.1 | GAGGCCAGTGGTGGAAACAGGTGTGGAGCTGATGAGTCTGCCCTACCGCCTGGTGTTTGCTG TGGCCTCGGA | SEQ ID NO: 2416 |
| CHD2 | NM_001271.1 | CTCTGTGCGAGGCTGTCAGCCACACTAGGTATCAGGGATCCCGAGATGGGTACCAGCCCAC AGTCCTTACC | SEQ ID NO: 2417 |
| CHFR | NM_018223.1 | AAGGAAGTGGTCCCTCTGTGGCAAGTGATGAAGTCTCCAGCTTTGCCTCAGCTCTCCCAGAC AGAAAGACTGCGTC | SEQ ID NO: 2418 |
| Chk1 | NM_001274.1 | GATAAATTGGTACAAGGGATCAGCTTTTCCCAGCCCACATGTCCTGATCATATGCTTTTGAA TAGTCAGTTACTTGGCACCC | SEQ ID NO: 2419 |
| Chk2 | NM_007194.1 | ATGTGGAACCCCCACCTACTTGGCGCCTGAAGTTCTTGTTTCTGTTGGGACTGCTGGGTATAA CCGTGCTGTGGACTG | SEQ ID NO: 2420 |
| CIAP1 | NM_001166.2 | TGCCTGTGGTGGGAAGCTCAGTAACTGGGAACCAAAGGATGATGCTATGTCAGAACACCGG AGGCATTTTCC | SEQ ID NO: 2421 |
| cIAP2 | NM_001165.2 | GGATATTTCCGTGGCTCTTATTCAAACTCTCCATCAAATCCTGTAAACTCCAGAGCAAATCA AGATTTTCTGCCTTGATGAGAAG | SEQ ID NO: 2422 |
| CKS1B | NM_001826.1 | GGTCCCTAAAACCCATCTGATGTCTGAATCTGAATGGAGGAATCTTGGCGTTCAGCAGAGTC AGGGATGGGTCCATTA | SEQ ID NO: 2423 |
| CKS2 | NM_001827.1 | GGCTGGACGTGGTTTTGTCTGCTGCGCCCGCTCTTCGCGCTCTCGTTTCATTTTCTGCAGCG | SEQ ID NO: 2424 |

TABLE B-continued

| Gene | Locus Link | Sequence | SEQ ID NO |
|---|---|---|---|
| Claudin 4 | NM_001305.2 | GGCTGCTTTGCTGCAACTGTCCACCCCGCACAGACAAGCCTTACTCCGCCAAGTATTCTGCT GCCCGCTCTG | SEQ ID NO: 2425 |
| CLDN1 | NM_021101.3 | TCTGGGAGGTGCCCTACTTTGCTGTTCCTGTCCCCGAAAAACAACCTCTTACCCAACACCAA GGCCCTATCCA | SEQ ID NO: 2426 |
| CLDN7 | NM_001307.3 | GGTCTGCCCTAGTCATCCTGGGAGGTGCACTGCTCTCCTGTTCCTGTCCTGGGAATGAGAGC AAGGCTGGGTAC | SEQ ID NO: 2427 |
| CLIC1 | NM_001288.3 | CGGTACTTGAGCAATGCCTACGCCCGGGAAGAATTCGCTTCCACCTGTCCAGATGATGAGGA GATCGA | SEQ ID NO: 2428 |
| CLTC | NM_004859.1 | ACCGTATGGACAGCCACAGCCTGGCTTTGGGTACAGCATGTGAGATGAAGCGCTGATCCTGT AGTCA | SEQ ID NO: 2429 |
| CLU | NM_001831.1 | CCCCAGGATACCTACCACTACCTGCCCTTCAGCCTGCCCCACCGGAGGCCTCACTTCTTCTTT CCCAAGTCCCGCA | SEQ ID NO: 2430 |
| cMet | NM_000245.1 | GACATTTCCAGTCCTGCAGTCAATGCCTCTCTGCCCCACCCTTTGTTCAGTGTGGCTGGTGCC ACGACAAATGTGTGCGATCGGAG | SEQ ID NO: 2431 |
| cMYC | NM_002467.1 | TCCCTCCACTCGGAAGGACTATCCTGCTGCCAAGAGGGTCAAGTTGGACAGTGTCAGAGTCC TGAGACAGATCAGCAACAACCG | SEQ ID NO: 2432 |
| CNN | NM_001299.2 | TCCACCCTCCTGGCTTTGGCCAGCATGGCGAAGACGAAAGGAAACAAGGTGAACGTGGGAG TGA | SEQ ID NO: 2433 |
| COL1A1 | NM_000088.2 | GTGGCCATCCAGCTGACCTTCCTGCGCCTGATGTCCACCGAGGCCTCCCAGAACATCACCTA CCACTG | SEQ ID NO: 2434 |
| COL1A2 | NM_000089.2 | CAGCCAAGAACTGGTATAGGAGCTCCAAGGACAAGAAACACGTCTGGCTAGGAGAAACTAT CAATGCTGGCAGCCAGTTT | SEQ ID NO: 2435 |
| COPS3 | NM_003653.2 | ATGCCCAGTGTTCCTGACTTCGAAACGCTATTCTCACAGGTTCAGCTCTTCATCAGCACTTGT AATGGGGAG | SEQ ID NO: 2436 |
| COX2 | NM_000963.1 | TCTGCAGAGTTGGAAGCACTCTATGGTGACATCGATGCTGTGGAGCTGTATCCTGCCCTTCT GGTAGAAAAGCCTCGGC | SEQ ID NO: 2437 |
| COX3 | MITO_COX3 | TCGAGTCTCCCTTCACCATTTCCGACGGCATCTACGGCTCAACATTTTTTGTAGCCACAGGCT TCCACGGACTTCACGTC | SEQ ID NO: 2438 |
| CP | NM_000096.1 | CGTGAGTACACAGATGCCTCCTTCACAAATCGAAAGGAGAGAGGCCCTGAAGAAGAGCATC TTGGCATCCTGG | SEQ ID NO: 2439 |
| CRBP | NM_002899.2 | TGGTCTGCAAGCAAGTATTCAAGAAGGTGCAGTGAGGCCCAAGCAGACAACCTTGTCCCAA CCAATCAGC | SEQ ID NO: 2440 |
| CREBBP | NM_004380.1 | TGGGAAGCAGCTGTGTACCATTCCTCGCGATGCTGCCTACTACAGCTATCAGAATAGGTATC ATTTCTGTGAGAAGTGTTTC | SEQ ID NO: 2441 |
| CRIP2 | NM_001312.1 | GTGCTACGCCACCCTGTTCGGACCCAAAGGCGTGAACATCGGGGGCGCGGGCTCCTACATCT ACGAGAAGCCCCTG | SEQ ID NO: 2442 |
| cripto (TDGF1 official) | NM_003212.1 | GGGTCTGTGCCCCATGACACCTGGCTGCCCAAGAAGTGTTCCCTGTGTAAATGCTGGCACGG TCA | SEQ ID NO: 2443 |

TABLE B-continued

| Gene | Locus Link | Sequence | SEQ ID NO |
|---|---|---|---|
| CRK(a) | NM_016823.2 | CTCCCTAACCTCCAGAATGGGCCCATATATGCCAGGGTTATCCAGAAGCGAGTCCCCAATGCCTACGACAAGACA | SEQ ID NO: 2444 |
| CRMP1 | NM_001313.1 | AAGGTTTTTGGATTGCAAGGGGTTTCCAGGGGCATGTATGACGGTCCTGTGTACGAGGTACCAGCTACACCC | SEQ ID NO: 2445 |
| CRYAB | NM_001885.1 | GATGTGATTGAGGTGCATGGAAAACATGAAGAGCGCCAGGATGAACATGGTTTCATCTCCAGGGAGTTC | SEQ ID NO: 2446 |
| CSEL1 | NM_001316.2 | TTACGCAGCTCATGCTCTTGAACGGCTCTTTACTATGCGAGGGCCTAACAATGCCACTCTCTTTACAGCTGC | SEQ ID NO: 2447 |
| CSF1 | NM_000757.3 | TGCAGCGGCTGATTGACAGTCAGATGGAGACCTCGTGCCAAATTACATTTGAGTTTGTAGACCAGGAACAGTTG | SEQ ID NO: 2448 |
| CSK (SRC) | NM_004383.1 | CCTGAACATGAAGGAGCTGAAGCTGCTGCAGACCATCGGGAAGGGGGAGTTCGGAGACGTGATG | SEQ ID NO: 2449 |
| CTAG1B | NM_001327.1 | GCTCTCCATCAGCTCCTGTCTCCAGCAGCTTTCCCTGTTGATGTGGATCACGCAGTGCTTTCTGCCCGTGTT | SEQ ID NO: 2450 |
| CTGF | NM_001901.1 | GAGTTCAAGTGCCCTGACGGCGAGGTCATGAAGAAGAACATGATGTTCATCAAGACCTGTGCCTGCCATTACAACT | SEQ ID NO: 2451 |
| CTHRC1 | NM_138455.2 | GCTCACTTCGGCTAAAATGCAGAAATGCATGCTGTCAGCGTTGGTATTTCACATTCAATGGAGCTGA | SEQ ID NO: 2452 |
| CTLA4 | NM_005214.2 | CACTGAGGTCCGGGTGACAGTGCTTCGGCAGGCTGACAGCCAGGTGACTGAAGTCTGTGCGGCAACCTAC | SEQ ID NO: 2453 |
| CTNNBIP1 | NM_020248.2 | GTTTTCCAGGTCGGAGACGGAAGACCGGAGGCAGTAGCTGCAAAGCCCTTGGAACACCTGGATGCT | SEQ ID NO: 2454 |
| CTSB | NM_001908.1 | GGCCGAGATCTACAAAAACGGCCCCGTGGAGGGAGCTTTCTCTGTGTATTCGGACTTCCTGC | SEQ ID NO: 2455 |
| CTSD | NM_001909.1 | GTACATGATCCCCTGTGAGAAGGTGTCCACCCTGCCCGCGATCACACTGAAGCTGGGAGGCAAAGGCTACAAGCTGTCCC | SEQ ID NO: 2456 |
| CTSH | NM_004390.1 | GCAAGTTCCAACCTGGAAAGGCCATCGGCTTTGTCAAGGATGTAGCCAACATCACAATCTATGACGAGGAAGCGATG | SEQ ID NO: 2457 |
| CTSL | NM_001912.1 | GGGAGGCTTATCTCACTGAGTGAGCAGAATCTGGTAGACTGCTCTGGGCCTCAAGGCAATGAAGGCTGCAATGG | SEQ ID NO: 2458 |
| CTSL2 | NM_001333.2 | TGTCTCACTGAGCGAGCAGAATCTGGTGGACTGTTCGCGTCCTCAAGGCAATCAGGGCTGCAATGGT | SEQ ID NO: 2459 |
| CUL1 | NM_003592.2 | ATGCCCTGGTAATGTCTGCATTCAACAATGACGCTGGCTTTGTGGCTGCTCTTGATAAGGCTTGTGGTCGC | SEQ ID NO: 2460 |
| CUL4A | NM_003589.1 | AAGCATCTTCCTGTTCTTGGACCGCACCTATGTGCTGCAGAACTCCACGCTGCCCTCCATCTGGGATATGGGATT | SEQ ID NO: 2461 |
| CXCL12 | NM_000609.3 | GAGCTACAGATGCCCATGCCGATTCTTCGAAAGCCATGTTGCCAGAGCCAACGTCAAGCATCTCAAA | SEQ ID NO: 2462 |

TABLE B-continued

| Gene | Locus Link | Sequence | SEQ ID NO |
|---|---|---|---|
| CXCR4 | NM_003467.1 | TGACCGCTTCTACCCCAATGACTTGTGGGTGGTTGTGTTCCAGTTTCAGCACATCATGGTTGG CCTTATCCT | SEQ ID NO: 2463 |
| CYBA | NM_000101.1 | GGTGCCTACTCCATTGTGGCGGGCGTGTTTGTGTGCCTGCTGGAGTACCCCCGGGGGAAGAG GAAGAAGGGCTCCAC | SEQ ID NO: 2464 |
| CYP1B1 | NM_000104.2 | CCAGCTTTGTGCCTGTCACTATTCCTCATGCCACCACTGCCAACACCTCTGTCTTGGGCTACC ACATTCCC | SEQ ID NO: 2465 |
| CYP2C8 | NM_000770.2 | CCGTGTTCAAGAGGAAGCTCACTGCCTTGTGGAGGAGTTGAGAAAAACCAAGGCTTCACCC TGTGATCCCACT | SEQ ID NO: 2466 |
| CYP3A4 | NM_017460.3 | AGAACAAGGACAACATAGATCCTTACATATACACACCCTTTGGAAGTGGACCCAGAAACTG CATTGGCATGAGGTTTGC | SEQ ID NO: 2467 |
| CYR61 | NM_001554.3 | TGCTCATTCTTGAGGAGCATTAAGGTATTTCGAAACTGCCAAGGGTGCTGGTGCGGATGGAC ACTAATGCAGCCAC | SEQ ID NO: 2468 |
| DAPK1 | NM_004938.1 | CGCTGACATCATGAATGTTCCTCGACCGGCTGGAGGCGAGTTTGGATATGACAAAGACACAT CGTTGCTGAAAGAGA | SEQ ID NO: 2469 |
| DCC | NM_005215.1 | AAATGTCCTCCTCGACTGCTCCGCGGAGTCCGACCGAGGAGTTCCAGTGATCAAGTGGAAG AAAGATGGCATTCA | SEQ ID NO: 2470 |
| DCC_exons18-23 | X76132_18-23 | GGTCACCGTTGGTGTCATCACAGTGCTGGTAGTGGTCATCGTGGCTGTGATTTGCACCCGAC GCTC | SEQ ID NO: 2471 |
| DCC_exons6-7 | X76132_6-7 | ATGGAGATGTGGTCATTCCTAGTGATTATTTTCAGATAGTGGGAGGAAGCAACTTACGGATA CTTGGGGTGGTG | SEQ ID NO: 2472 |
| DCK | NM_000788.1 | GCCGCCACAAGACTAAGGAATGGCCACCCCGCCCAAGAGAAGCTGCCCGTCTTTCTCAGCC AGCTCTGAGGGGACCCGCATCAAGAAAATCTCCATCGAAGGGAACATCG | SEQ ID NO: 2473 |
| DDB1 | NM_001923.2 | TGCGGATCATCCGGAATGGAATTGGAATCCACGAGCATGCCAGCATTGACTTACCAGGCATC AAAGGA | SEQ ID NO: 2474 |
| DET1 | NM_017996.2 | CTTGTGGAGATCACCCAATCAGGTTCTATGCCCGGGACTCGGGCCTGCTCAAGTTTGAGATC CAGGCGGG | SEQ ID NO: 2475 |
| DHFR | NM_000791.2 | TTGCTATAACTAAGTGCTTCTCCAAGACCCCAACTGAGTCCCCAGCACCTGCTACAGTGAGC TGCCATTCCAC | SEQ ID NO: 2476 |
| DHPS | NM_013407.1 | GGGAGAACGGGATCAATAGGATCGGAAACCTGCTGGTGCCCAATGAGAATTACTGCAAGTT TGAGGACTGGCTGATGC | SEQ ID NO: 2477 |
| DIABLO | NM_019887.1 | CACAATGGCGGCTCTGAAGAGTTGGCTGTCGCGCAGCGTAACTTCATTCTTCAGGTACAGAC AGTGTTTGTGT | SEQ ID NO: 2478 |
| DIAPH1 | NM_005219.2 | CAAGCAGTCAAGGAGAACCAGAAGCGGCGGGAGACAGAAGAAAAGATGAGGCGAGCAAA ACT | SEQ ID NO: 2479 |
| DICER1 | NM_177438.1 | TCCAATTCCAGCATCACTGTGGAGAAAAGCTGTTTGTCTCCCCAGCATACTTTATCGCCTTCA CTGCC | SEQ ID NO: 2480 |
| DKK1 | NM_012242.1 | TGACAACTACCAGCCGTACCCGTGCGCAGAGGACGAGGAGTGCGGCACTGATGAGTACTGC GCTAGTCCC | SEQ ID NO: 2481 |

TABLE B-continued

| Gene | Locus Link | Sequence | SEQ ID NO |
|---|---|---|---|
| DLC1 | NM_006094.3 | GATTCAGACGAGGATGAGCCTTGTGCCATCAGTGGCAAATGGACTTTCCAAAGGGACAGCA AGAGGTG | SEQ ID NO: 2482 |
| DPYD | NM_000110.2 | AGGACGCAAGGAGGGTTTGTCACTGGCAGACTCGAGACTGTAGGCACTGCCATGGCCCCTG TGCTCAGTAAGGACTCGGCGGACATC | SEQ ID NO: 2483 |
| DR4 | NM_003844.1 | TGCACAGAGGGTGTGGGTTACACCAATGCTTCCAACAATTTGTTTGCTTGCCTCCCATGTAC AGCTTGTAAATCAGATGAAGA | SEQ ID NO: 2484 |
| DR5 | NM_003842.2 | CTCTGAGACAGTGCTTCGATGACTTTGCAGACTTGGTGCCCTTTGACTCCTGGGAGCCGCTC ATGAGGAAGTTGGGCCTCATGG | SEQ ID NO: 2485 |
| DRG1 | NM_004147.3 | CCTGGATCTCCCAGGTATCATTGAAGGTGCCAAGGATGGGAAAGGTAGAGGTCGTCAAGTC ATTGCA | SEQ ID NO: 2486 |
| DSP | NM_004415.1 | TGGCACTACTGCATGATTGACATAGAGAAGATCAGGGCCATGACAATCGCCAAGCTGAAAA CAATGCGGCAGG | SEQ ID NO: 2487 |
| DTYMK | NM_012145.1 | AAATCGCTGGGAACAAGTGCCGTTAATTAAGGAAAAGTTGAGCCAGGGCGTGACCCTCGTC GTGGACAGATACGCATT | SEQ ID NO: 2488 |
| DUSP1 | NM_004417.2 | AGACATCAGCTCCTGGTTCAACGAGGCCATTGACTTCATAGACTCCATCAAGAATGCTGGAG GAAGGGTGTTTGTC | SEQ ID NO: 2489 |
| DUSP2 | NM_004418.2 | TATCCCTGTGGAGGACAACCAGATGGTGGAGATCAGTGCCTGGTTCCAGGAGGCCATAGGC TTCATTGACTGGGTG | SEQ ID NO: 2490 |
| DUT | NM_001948.2 | ACACATGGAGTGCTTCTGGAACTATCAGCCCACTTGACCACCCAGTTTGTGGAAGCACAGGC AAGAG | SEQ ID NO: 2491 |
| DYRK1B | NM_004714.1 | AGCATGACACGGAGATGAAGTACTATATAGTACACCTGAAGCGGCACTTCATGTTCCGGAA CCACCTGTGCCTGGTATT | SEQ ID NO: 2492 |
| E2F1 | NM_005225.1 | ACTCCCTCTACCCTTGAGCAAGGGCAGGGGTCCCTGAGCTGTTCTTCTGCCCCATACTGAAG GAACTGAGGCCTG | SEQ ID NO: 2493 |
| EDN1 endothelin | NM_001955.1 | TGCCACCTGGACATCATTTGGGTCAACACTCCCGAGCACGTTGTTCCGTATGGACTTGGAAG CCCTAGGTCCA | SEQ ID NO: 2494 |
| EFNA1 | NM_004428.2 | TACATCTCCAAACCCATCCACCAGCATGAAGACCGCTGCTTGAGGTTGAAGGTGACTGTCAG TGGCAA | SEQ ID NO: 2495 |
| EFNA3 | NM_004952.3 | ACTACATCTCCACGCCCACTCACAACCTGCACTGGAAGTGTCTGAGGATGAAGGTGTTCGTC TGCTG | SEQ ID NO: 2496 |
| EFNB1 | NM_004429.3 | GGAGCCCGTATCCTGGAGCTCCCTCAACCCCAAGTTCCTGAGTGGGAAGGGCTTGGTGATCT ATCC | SEQ ID NO: 2497 |
| EFNB2 | NM_004093.2 | TGACATTATCATCCCGCTAAGGACTGCGGACAGCGTCTTCTGCCCTCACTACGAGAAGGTCA GCGGGGACTAC | SEQ ID NO: 2498 |
| EFP | NM_005082.2 | TTGAACAGAGCCTGACCAAGAGGGATGAGTTCGAGTTTCTGGAGAAAGCATCAAAACTGCG AGGAATCTCAACA | SEQ ID NO: 2499 |
| EGFR | NM_005228.1 | TGTCGATGGACTTCCAGAACCACCTGGGCAGCTGCCAAAAGTGTGATCCAAGCTGTCCCAAT | SEQ ID NO: 2500 |

TABLE B-continued

| Gene | Locus Link | Sequence | SEQ ID NO |
|---|---|---|---|
| EGLN1 | NM_022051.1 | TCAATGGCCGGACGAAAGCCATGGTTGCTTGTTATCCGGGCAATGGAACGGGTTATGTACGT CATGTTGATAATCCAAA | SEQ ID NO: 2501 |
| EGLN3 | NM_022073.2 | GCTGGTCCTCTACTGCGGGAGCCGGCTGGGCAAATACTACGTCAAGGAGAGGTCTAAGGCA ATGGTGG | SEQ ID NO: 2502 |
| EGR1 | NM_001964.2 | GTCCCCGCTGCAGATCTCTGACCCGTTCGGATCCTTTCCTCACTCGCCCACCATGGACAACTA CCCTAAGCTGGAG | SEQ ID NO: 2503 |
| EGR3 | NM_004430.2 | CCATGTGGATGAATGAGGTGTCTCCTTTCCATACCCAGTCTCACCTTCTCCCCACCCTACCTC ACCTCTTCTCAGGCA | SEQ ID NO: 2504 |
| EI24 | NM_004879.2 | AAAGTGGTGAATGCCATTTGGTTTCAGGATATAGCTGACCTGGCATTTGAGGTATCAGGGAG GAAGCCTCAC | SEQ ID NO: 2505 |
| EIF4E | NM_001968.1 | GATCTAAGATGGCGACTGTCGAACCGGAAACCACCCCTACTCCTAATCCCCCGACTACAGAA GAGGAGAAAACGGAATCTAA | SEQ ID NO: 2506 |
| EIF4EL3 | NM_004846.1 | AAGCCGCGGTTGAATGTGCCATGACCCTCTCCCTCTCTGGATGGCACCATCATTGAAGCTGG CGTCA | SEQ ID NO: 2507 |
| ELAVL1 | NM_001419.2 | GACAGGAGGCCTCTATCCTGTCCCTCCACCCCACCCTCCACCTCAATCCCCTCCCATCTTCCC CAGACCTACCTCAC | SEQ ID NO: 2508 |
| EMP1 | NM_001423.1 | GCTAGTACTTTGATGCTCCCTTGATGGGGTCCAGAGAGCCTCCCTGCAGCCACCAGACTTGG CCTCCAGCTGTTC | SEQ ID NO: 2509 |
| EMR3 | NM_032571.2 | TGGCCTACCTCTTCACCATCATCAACAGCCTCCAAGGCTTCTTCATCTTCTTGGTCTACTGCC TCCTCA | SEQ ID NO: 2510 |
| EMS1 | NM_005231.2 | GGCAGTGTCACTGAGTCCTTGAAAATCCTCCCCTGCCCCGCGGGTCTCTGGATTGGGACGCAC AGTGCA | SEQ ID NO: 2511 |
| ENO1 | NM_001428.2 | CAAGGCCGTGAACGAGAAGTCCTGCAACTGCCTCCTGCTCAAAGTCAACCAGATTGGCTCCG TGACCG | SEQ ID NO: 2512 |
| EP300 | NM_001429.1 | AGCCCCAGCAACTACAGTCTGGGATGCCAAGGCCAGCCATGATGTCAGTGGCCCAGCATGG TCAACCTTTGAACA | SEQ ID NO: 2513 |
| EPAS1 | NM_001430.3 | AAGCCTTGGAGGGTTTCATTGCCGTGGTGACCCAAGATGGCGACATGATCTTTCTGTCAGAA AACATCAGCA | SEQ ID NO: 2514 |
| EpCAM | NM_002354.1 | GGGCCCTCCAGAACAATGATGGGCTTTATGATCCTGACTGCGATGAGAGCGGGCTCTTTAAG GCCAAGCAGTGCA | SEQ ID NO: 2515 |
| EPHA2 | NM_004431.2 | CGCCTGTTCACCAAGATTGACACCATTGCGCCCGATGAGATCACCGTCAGCAGCGACTTCGA GGCACGCCAC | SEQ ID NO: 2516 |
| EPHB2 | NM_004442.4 | CAACCAGGCAGCTCCATCGGCAGTGTCCATCATGCATCAGGTGAGCCGCACCGTGGACAGC ATTAC | SEQ ID NO: 2517 |
| EPHB4 | NM_004444.3 | TGAACGGGGTATCCTCCTTAGCCACGGGGCCCGTCCCATTTGAGCCTGTCAATGTCACCACT GACCGAGAGGTACCT | SEQ ID NO: 2518 |
| EphB6 | NM_004445.1 | ACTGGTCCTCCATCGGCTCCCCAGGAGCTTTGGTTTGAGGTGCAAGGCTCAGCACTCATGCT ACACTGG | SEQ ID NO: 2519 |

TABLE B-continued

| Gene | Locus Link | Sequence | SEQ ID NO |
|---|---|---|---|
| EPM2A | NM_005670.2 | ACTGTGGCACTTAGGGGAGATGACATTTGCTTTGGGCAGAGGCAGCTAGCCAGGACACATTT CCACT | SEQ ID NO: 2520 |
| ErbB3 | NM_001982.1 | CGGTTATGTCATGCCAGATACACACCTCAAAGGTACTCCCTCCTCCCGGGAAGGCACCCTTT CTTCAGTGGGTCTCAGTTC | SEQ ID NO: 2521 |
| ERCC1 | NM_001983.1 | GTCCAGGTGGATGTGAAAGATCCCCAGCAGGCCCTCAAGGAGCTGGCTAAGATGTGTATCC TGGCCG | SEQ ID NO: 2522 |
| ERCC2 | NM_000400.2 | TGGCCTTCTTCACCAGCTACCAGTACATGGAGAGCACCGTGGCCTCCTGGTATGAGCAGGGG ATCCTTG | SEQ ID NO: 2523 |
| EREG | NM_001432.1 | ATAACAAAGTGTAGCTCTGACATGAATGGCTATTGTTTGCATGGACAGTGCATCTATCTGGT GGACATGAGTCAAAACTACTGCAGGTGTG | SEQ ID NO: 2524 |
| ERK1 | Z11696.1 | ACGGATCACAGTGGAGGAAGCGCTGGCTCACCCCTACCTGGAGCAGTACTATGACCCGACG GATGAG | SEQ ID NO: 2525 |
| ERK2 | NM_002745.1 | AGTTCTTGACCCCTGGTCCTGTCTCCAGCCCGTCTTGGCTTATCCACTTTGACTCCTTTGAGC CGTTT | SEQ ID NO: 2526 |
| ESPL1 | NM_012291.1 | ACCCCCAGACCGGATCAGGCAAGCTGGCCCTCATGTCCCCTTCACGGTGTTTGAGGAAGTCT GCCCTACA | SEQ ID NO: 2527 |
| EstR1 | NM_000125.1 | CGTGGTGCCCCTCTATGACCTGCTGCTGGAGATGCTGGACGCCCACCGCCTACATGCGCCCA CTAGCC | SEQ ID NO: 2528 |
| ETV4 | NM_001986.1 | TCCAGTGCCTATGACCCCCCCAGACAAATCGCCATCAAGTCCCCTGCCCCTGGTGCCCTTGG ACAGT | SEQ ID NO: 2529 |
| F3 | NM_001993.2 | GTGAAGGATGTGAAGCAGACGTACTTGGCACGGGTCTTCTCCTACCCGGCAGGGAATGTGG AGAGCACCGGTT | SEQ ID NO: 2530 |
| FABP4 | NM_001442.1 | GCTTTGCCACCAGGAAAGTGGCTGGCATGGCCAAACCTAACATGATCATCAGTGTGAATGG GGATG | SEQ ID NO: 2531 |
| FAP | NM_004460.2 | CTGACCAGAACCACGGCTTATCCGGCCTGTCCACGAACCACTTATACACCCACATGACCCAC TTCC | SEQ ID NO: 2532 |
| fas | NM_000043.1 | GGATTGCTCAACAACCATGCTGGGCATCTGGACCCTCCTACCTCTGGTTCTTACGTCTGTTGC TAGATTATCGTCCAAAAGTGTTAATGCC | SEQ ID NO: 2533 |
| fasI | NM_000639.1 | GCACTTTGGGATTCTTTCCATTATGATTCTTTGTTACAGGCACCGAGAATGTTGTATTCAGTG AGGGTCTTCTTACATGC | SEQ ID NO: 2534 |
| FASN | NM_004104.4 | GCCTCTTCCTGTTCGACGGCTCGCCCACCTACGTACTGGCCTACACCCAGAGCTACCGGGCA AAGC | SEQ ID NO: 2535 |
| FBXO5 | NM_012177.2 | GGCTATTCCTCATTTTCTCTACAAAGTGGCCTCAGTGAACATGAAGAAGGTAGCCTCCTGGA GGAGAATTTCGGTGACAGTCTACAATCC | SEQ ID NO: 2536 |
| FBXW7 | NM_033632.1 | CCCCAGTTTCAACGAGACTTCATTTCATTGCTCCCTAAAGAGTTGGCACTCTATGTGCTTTCA TTCCTGGAAC | SEQ ID NO: 2537 |
| FDXR | NM_004110.2 | GAGATGATTCAGTTACCGGGAGCCCGGCCCATTTTGGATCCTGTGGATTTCTTGGGTCTCCA GGACAAGAT | SEQ ID NO: 2538 |

TABLE B-continued

| Gene | Locus Link | Sequence | SEQ ID NO |
|---|---|---|---|
| FES | NM_002005.2 | CTCTGCAGGCCTAGGTGCAGCTCCTCAGCGGCTCCAGCTCATATGCTGACAGCTCTTCACAGTCCTGG | SEQ ID NO: 2539 |
| FGF18 | NM_003862.1 | CGGTAGTCAAGTCCGGATCAAGGGCAAGGAGACGGAATTCTACCTGTGCATGAACCGCAAAGGCAAGC | SEQ ID NO: 2540 |
| FGF2 | NM_002006.2 | AGATGCAGGAGAGAGGAAGCCTTGCAAACCTGCAGACTGCTTTTTGCCCAATATAGATTGGGTAAGGCTGCAAAAC | SEQ ID NO: 2541 |
| FGFR1 | NM_023109.1 | CACGGGACATTCACCACATCGACTACTATAAAAAGACAACCAACGGCCGACTGCCTGTGAAGTGGATGGCACCC | SEQ ID NO: 2542 |
| FGFR2 isoform 1 | NM_000141.2 | GAGGGACTGTTGGCATGCAGTGCCCTCCCAGAGACCAACGTTCAAGCAGTTGGTAGAAGACTTGGATCGAATTCTCACTC | SEQ ID NO: 2543 |
| FHIT | NM_002012.1 | CCAGTGGAGCGCTTCCATGACCTGCGTCCTGATGAAGTGGCCGATTTGTTTCAGACGACCCAGAGAG | SEQ ID NO: 2544 |
| FIGF | NM_004469.2 | GGTTCCAGCTTTCTGTAGCTGTAAGCATTGGTGGCCACACCACCTCCTTACAAAGCAACTAGAACCTGCGGC | SEQ ID NO: 2545 |
| FLJ12455 | NM_022078.1 | CCACCAGCATGAAGTTTCGGACAGACATGGCCTTTGTGAGGGGTTCCAGTTGTGCTTCAGACAGCC | SEQ ID NO: 2546 |
| FLJ20712 | AK000719.1 | GCCACACAAACATGCTCCTGCTCCTGGCGGAGGCAGAGCTGCTGGGAAAGACATTTCGGAAGTTTCCTGTGGC | SEQ ID NO: 2547 |
| FLT1 | NM_002019.1 | GGCTCCCGAATCTATCTTTGACAAAATCTACAGCACCAAGAGCGACGTGTGGTCTTACGGAGTATTGCTGTGGGA | SEQ ID NO: 2548 |
| FLT4 | NM_002020.1 | ACCAAGAAGCTGAGGACCTGTGGCTGAGCCCGCTGACCATGGAAGATCTTGTCTGCTACAGCTTCCAGG | SEQ ID NO: 2549 |
| FOS | NM_005252.2 | CGAGCCCTTTGATGACTTCCTGTTCCCAGCATCATCCAGGCCCAGTGGCTCTGAGACAGCCCGCTCC | SEQ ID NO: 2550 |
| FOXO3A | NM_001455.1 | TGAAGTCCAGGACGATGATGCGCCTCTCTCGCCCATGCTCTACAGCAGCTCAGCCAGCCTGTCACCTTCAGTAAGCAAGCCGT | SEQ ID NO: 2551 |
| FPGS | NM_004957.3 | CAGCCCTGCCAGTTTGACTATGCCGTCTTCTGCCCTAACCTGACAGAGGTGTCATCCACAGGCAAC | SEQ ID NO: 2552 |
| FRP1 | NM_003012.2 | TTGGTACCTGTGGGTTAGCATCAAGTTCTCCCCAGGGTAGAATTCAATCAGAGCTCCAGTTTGCATTTGGATGTG | SEQ ID NO: 2553 |
| FST | NM_006350.2 | GTAAGTCGGATGAGCCTGTCTGTGCCAGTGACAATGCCACTTATGCCAGCGAGTGTGCCATGAAGGAAGCTG | SEQ ID NO: 2554 |
| Furin | NM_002569.1 | AAGTCCTCGATACGCACTATAGCACCGAGAATGACGTGGAGACCATCCGGGCCAGCGTCTGCGCCCCCTGCCACGCCTCATGTGCCACATGCCAG | SEQ ID NO: 2555 |
| FUS | NM_004960.1 | GGATAATTCAGACAACAACACCATCTTTGTGCAAGGCCTGGGTGAGAATGTTACAATTGAGTCTGTGGCTGATTACTTCA | SEQ ID NO: 2556 |
| FUT1 | NM_000148.1 | CCGTGCTCATTGCTAACCACTGTCTGTCCCTGAACTCCCAGAACCACTACATCTGGCTTTGGGCAG | SEQ ID NO: 2557 |

TABLE B-continued

| Gene | Locus Link | Sequence | SEQ ID NO |
|---|---|---|---|
| FUT3 | NM_000149.1 | CAGTTCGGTCCAACAGAGAAAGCAGGCAACCACCATGTCATTTGAAAACAGTTTCATCGGG ATATAATTCGCA | SEQ ID NO: 2558 |
| FUT6 | NM_000150.1 | CGTGTGTCTCAAGACGATCCCACTGTGTACCCTAATGGGTCCCGCTTCCCAGACAGCACAGG GACC | SEQ ID NO: 2559 |
| FXYD5 | NM_014164.4 | AGAGCACCAAAGCAGCTCATCCCACTGATGACACCACGACGCTCTCTGAGAGACCATCCCC AAGCAC | SEQ ID NO: 2560 |
| FYN | NM_002037.3 | GAAGCGCAGATCATGAAGAAGCTGAAGCACGACAAGCTGGTCCAGCTCTATGCAGTGGTGT CTGAGGAG | SEQ ID NO: 2561 |
| FZD1 | NM_003505.1 | GGTGCACCAGTTCTACCCTCTAGTGAAAGTGCAGTGTTCCGCTGAGCTCAAGTTCTTCCTGTG CTCCATGTACGC | SEQ ID NO: 2562 |
| FZD2 | NM_001466.2 | TGGATCCTCACCTGGTCGGTGCTGTGCTGCGCTTCCACCTTCTTCACTGTCACCACGTACTTG GTAGACATGCAGCGC | SEQ ID NO: 2563 |
| FZD6 | NM_003506.2 | AATGAGAGAGGTGAAAGCGGACGGAGCTAGCACCCCCAGGTTAAGAGAACAGGACTGTGG TGAACCT | SEQ ID NO: 2564 |
| G-Catenin | NM_002230.1 | TCAGCAGCAAGGGCATCATGGAGGAGGATGAGGCCTGCGGGCGCCAGTACACGCTCAAGAA AACCACC | SEQ ID NO: 2565 |
| G1P2 | NM_005101.1 | CAACGAATTCCAGGTGTCCCTGAGCAGCTCCATGTCGGTGTCAGAGCTGAAGGCGCAGATC | SEQ ID NO: 2566 |
| GADD45 | NM_001924.2 | GTGCTGGTGACGAATCCACATTCATCTCAATGGAAGGATCCTGCCTTAAGTCAACTTATTTG TTTTTGCCGGG | SEQ ID NO: 2567 |
| GADD45B | NM_015675.1 | ACCCTCGACAAGACCACACTTTGGGACTTGGGAGCTGGGGCTGAAGTTGCTCTGTACCCATG AACTCCCA | SEQ ID NO: 2568 |
| GADD45G | NM_006705.2 | CGCGCTGCAGATCCATTTTACGCTGATCCAGGCTTTCTGCTGCGAGAACGACATCGACATAG TGCG | SEQ ID NO: 2569 |
| GAGE4 | NM_001474.1 | GGAACAGGGTCACCCACAGACTGGGTGTGAGTGTGAAGATGGTCCTGATGGGCAGGAGATG GACCCGCCAAATC | SEQ ID NO: 2570 |
| GBP1 | NM_002053.1 | TTGGGAAATATTTGGGCATTGGTCTGGCCAAGTCTACAATGTCCCAATATCAAGGACAACCA CCCTAGCTTCT | SEQ ID NO: 2571 |
| GBP2 | NM_004120.2 | GCATGGGAACCATCAACCAGCAGGCCATGGACCAACTTCACTATGTGACAGAGCTGACAGA TCGAATCAAGGCAAACTCCTCA | SEQ ID NO: 2572 |
| GCLC | NM_001498.1 | CTGTTGCAGGAAGGCATTGATCATCTCCTGGCCCAGCATGTTGCTCATCTCTTTATTAGAGAC CCACTGAC | SEQ ID NO: 2573 |
| GCLM | NM_002061.1 | TGTAGAATCAAACTCTTCATCATCAACTAGAAGTGCAGTTGACATGGCCTGTTCAGTCCTTG GAGTTGCACAGCTGGATTCTGTG | SEQ ID NO: 2574 |
| GCNT1 | NM_001490.3 | TGGTGCTTGGAGCATAGAAGACTGCCCTTCACAAAGGAAATCCCTGATTATTGTTTGAAATG CTGAGGACGTTGC | SEQ ID NO: 2575 |
| GDF15 | NM_004864.1 | CGCTCCAGACCTATGATGACTTGTTAGCCAAAGACTGCCACTGCATATGAGCAGTCCTGGTC CTTCCACTGT | SEQ ID NO: 2576 |

TABLE B-continued

| Gene | Locus Link | Sequence | SEQ ID NO |
|---|---|---|---|
| GIT1 | NM_014030.2 | GTGTATGACGAGGTGGATCGAAGAGAAAATGATGCAGTGTGGCTGGCTACCCAAAACCACAGCACTCTGGT | SEQ ID NO: 2577 |
| GJA1 | NM_000165.2 | GTTCACTGGGGGTGTATGGGGTAGATGGGTGGAGAGGGAGGGGATAAGAGAGGTGCATGTTGGTATTT | SEQ ID NO: 2578 |
| GJB2 | NM_004004.3 | TGTCATGTACGACGGCTTCTCCATGCAGCGGCTGGTGAAGTGCAACGCCTGGCCTTGTCCCAACACTGTGGACT | SEQ ID NO: 2579 |
| GPX1 | NM_000581.2 | GCTTATGACCGACCCCAAGCTCATCACCTGGTCTCCGGTGTGTCGCAACGATGTTGCCTGGAACTTT | SEQ ID NO: 2580 |
| GPX2 | NM_002083.1 | CACACAGATCTCCTACTCCATCCAGTCCTGAGGAGCCTTAGGATGCAGCATGCCTTCAGGAGACACTGCTGGACC | SEQ ID NO: 2581 |
| Grb10 | NM_005311.2 | CTTCGCCTTTGCTGATTGCCTCTCCAAACGCCTGCCTGACGACTGCCTTGGAGCATGTGCGTTATGG | SEQ ID NO: 2582 |
| GRB14 | NM_004490.1 | TCCCACTGAAGCCCTTTCAGTTGCGGTTGAAGAAGGACTCGCTTGGAGGAAAAAGGATGTTTACGCCTGGGCACT | SEQ ID NO: 2583 |
| GRB2 | NM_002086.2 | GTCCATCAGTGCATGACGTTTAAGGCCACGTATAGTCCTAGCTGACGCCAATAATAAAAACAAGAAACCAAGTGGGCT | SEQ ID NO: 2584 |
| GRB7 | NM_005310.1 | CCATCTGCATCCATCTTGTTTGGGCTCCCCACCCTTGAGAAGTGCCTCAGATAATACCCTGGTGGCC | SEQ ID NO: 2585 |
| GRIK1 | NM_000830.2 | GTTGGGTGCATCTCTCGGGCGTCCGGCAGCGGCTGTATCTCGGCATGAATTAAGAAGCTAGGAAGATGGAGCACG | SEQ ID NO: 2586 |
| GRO1 | NM_001511.1 | CGAAAAGATGCTGAACAGTGACAAATCCAACTGACCAGAAGGGAGGAGGAAGCTCACTGGTGGCTGTTCCTGA | SEQ ID NO: 2587 |
| GRP | NM_002091.1 | CTGGGTCTCATAGAAGCAAAGGAGAACAGAAACCACCAGCCACCTCAACCCAAGGCCTTGGGCAATCAGCAGCCTTCGTGG | SEQ ID NO: 2588 |
| GRPR | NM_005314.1 | ATGCTGCTGGCCATTCCAGAGGCCGTGTTTTCTGACCTCCATCCCTTCCATGAGGAAAGCACCAACCAGACCT | SEQ ID NO: 2589 |
| GSK3B | NM_002093.2 | GACAAGGACGGCAGCAAGGTGACAACAGTGGTGGCAACTCCTGGGCAGGGTCCAGACAGGCCACAA | SEQ ID NO: 2590 |
| GSTA3 | NM_000847.3 | TCTCCAACTTCCCTCTGCTGAAGGCCCTGAAAACCAGAATCAGCAACCTGCCCACGGTGAAGAAGT | SEQ ID NO: 2591 |
| GSTM1 | NM_000561.1 | AAGCTATGAGGAAAAGAAGTACACGATGGGGACGCTCCTGATTATGACAGAAGCCAGTGGCTGAATGAAAAATTCAAGCTGGGCC | SEQ ID NO: 2592 |
| GSTM3 | NM_000849.3 | CAATGCCATCTTGCGCTACATCGCTCGCAAGCACAACATGTGTGGTGAGACTGAAGAAGAAAAGATTCGAGTGGAC | SEQ ID NO: 2593 |
| GSTp | NM_000852.2 | GAGACCCTGCTGTCCCAGAACCAGGGAGGCAAGACCTTCATTGTGGGAGACCAGATCTCCTTCGCTGACTACAACC | SEQ ID NO: 2594 |
| GSTT1 | NM_000853.1 | CACCATCCCCACCCTGTCTTCCACAGCCGCCTGAAAGCCACAATGAGAATGATGCACACTGAGGCC | SEQ ID NO: 2595 |

TABLE B-continued

| Gene | Locus Link | Sequence | SEQ ID NO |
|---|---|---|---|
| H2AFZ | NM_002106.2 | CCGGAAAGGCCAAGACAAAGGCGGTTTCCCGCTCGCAGAGAGCCGGCTTGCAGTTCCCAGT GGGCCGTATT | SEQ ID NO: 2596 |
| HB-EGF | NM_001945.1 | GACTCCTTCGTCCCCAGTTGCCGTCTAGGATTGGGCCTCCCATAATTGCTTTGCCAAAATACC AGAGCCTTCAAGTGCCA | SEQ ID NO: 2597 |
| hCRA a | U78556.1 | TGACACCCTTACCTTCCTGAGAAATACCCCCTGGGAGCGCGGAAAGCAGAGCGGACAGGTC AGTGACTTCTATTTTTGACTCGTGTTTTT | SEQ ID NO: 2598 |
| HDAC1 | NM_004964.2 | CAAGTACCACAGCGATGACTACATTAAATTCTTGCGCTCCATCCGTCCAGATAACATGTCGG AGTACAGCAAGC | SEQ ID NO: 2599 |
| HDAC2 | NM_001527.1 | GGTGGCTACACAATCCGTAATGTTGCTCGATGTTGGACATATGAGACTGCAGTTGCCCTTGA TTGTGAGATTCCCA | SEQ ID NO: 2600 |
| HDGF | NM_004494.1 | TCCTAGGCATTCTGGACCTCTGGGTTGGGATCAGGGGTAGGAATGGAAGGATGGAGCATCA ACAGC | SEQ ID NO: 2601 |
| hENT1 | NM_004955.1 | AGCCGTGACTGTTGAGGTCAAGTCCAGCATCGCAGGCAGCAGCACCTGGGAACGTTACTT | SEQ ID NO: 2602 |
| Hepsin | NM_002151.1 | AGGCTGCTGGAGGTCATCTCCGTGTGTGATTGCCCCAGAGGCCGTTTCTTGGCCGCCATCTG CCAAGACTGTGGCCGCAGGAAG | SEQ ID NO: 2603 |
| HER2 | NM_004448.1 | CGGTGTGAGAAGTGCAGCAAGCCCTGTGCCCGAGTGTGCTATGGTCTGGGCATGGAGCACTT GCGAGAGG | SEQ ID NO: 2604 |
| Herstatin | AF177761.2 | CACCCTGTCCTATCCTTCCTCAGACCCTCTTGGGACCTAGTCTCTGCCTTCTACTCTCTACCCC TGGCC | SEQ ID NO: 2605 |
| HES6 | NM_018645.3 | TTAGGGACCCTGCAGCTCTGGAGTGGGTGGAGGGAGGGAGCTACGGGCAGGAGGAAGAATT TTGTAG | SEQ ID NO: 2606 |
| HGF | M29145.1 | CCGAAATCCAGATGATGATGCTCATGGACCCTGGTGCTACACGGGAAATCCACTCATTCCTT GGG | SEQ ID NO: 2607 |
| HIF1A | NM_001530.1 | TGAACATAAAGTCTGCAACATGGAAGGTATTGCACTGCACAGGCCACATTCACGTATATGAT ACCAACAGTAACCAACCTCA | SEQ ID NO: 2608 |
| HK1 | NM_000188.1 | TACGCACAGAGGCAAGCAGCTAAGAGTCCGGGATCCCCAGCCTACTGCCTCTCCAGCACTTC TCTC | SEQ ID NO: 2609 |
| HLA-DPB1 | NM_002121.4 | TCCATGATGGTTCTGCAGGTTTCTGCGGCCCCCCGGACAGTGGCTCTGACGGCGTTACTGAT GGTGCTGCTCA | SEQ ID NO: 2610 |
| HLA-DRA | NM_019111.3 | GACGATTTGCCAGCTTTGAGGCTCAAGGTGCATTGGCCAACATAGCTGTGGACAAAGCCAA CCTGGA | SEQ ID NO: 2611 |
| HLA-DRB1 | NM_002124.1 | GCTTTCTCAGGACCTGGTTGCTACTGGTTCGGCAACTGCAGAAAATGTCCTCCCTTGTGGCTT CCT | SEQ ID NO: 2612 |
| HLA-G | NM_002127.2 | CCTGCGCGGCTACTACAACCAGAGCGAGGCCAGTTCTCACACCCTCCAGTGGATGATTGGCT GCGACCTG | SEQ ID NO: 2613 |
| HMGB1 | NM_002128.3 | TGGCCTGTCCATTGGTGATGTTGCGAAGAAACTGGGAGAGATGTGGAATAACACTGCTGCA GATGACAAGC | SEQ ID NO: 2614 |

TABLE B-continued

| Gene | Locus Link | Sequence | SEQ ID NO |
|---|---|---|---|
| hMLH | NM_000249.2 | CTACTTCCAGCAACCCCAGAAAGAGACATCGGGAAGATTCTGATGTGGAAATGGTGGAAGATGATTCCCGAAAG | SEQ ID NO: 2615 |
| HNRPAB | NM_004499.2 | CAAGGGAGCGACCAACTGATCGCACACATGCTTTGTTTGGATATGGAGTGAACACAATTATGTACCAAATTTAACTTGGCAAAC | SEQ ID NO: 2616 |
| HNRPD | NM_031370.2 | GCCAGTAAGAACGAGGAGGATGAAGGCCATTCAAACTCCTCCCCACGACACTCTGAAGCAGCGACG | SEQ ID NO: 2617 |
| HoxA1 | NM_005522.3 | AGTGACAGATGGACAATGCAAGAATGAACTCCTTCCTGGAATACCCCATACTTAGCAGTGGCGACTCGG | SEQ ID NO: 2618 |
| HoxA5 | NM_019102.2 | TCCCTTGTGTTCCTTCTGTGAAGAAGCCCTGTTCTCGTTGCCCTAATTCATCTTTTAATCATGAGCCTGTTTATTGCC | SEQ ID NO: 2619 |
| HOXB13 | NM_006361.2 | CGTGCCTTATGGTTACTTTGGAGGCGGGTACTACTCCTGCCGAGTGTCCCGGAGCTCGCTGAAACCCTGTG | SEQ ID NO: 2620 |
| HOXB7 | NM_004502.2 | CAGCCTCAAGTTCGGTTTTCGCTACCGGAGCCTTCCCAGAACAAACTTCTTGTGCGTTTGCTTCCAAC | SEQ ID NO: 2621 |
| HRAS | NM_005343.2 | GGACGAATACGACCCCACTATAGAGGATTCCTACCGGAAGCAGGTGGTCATTGATGGGAGACGTGC | SEQ ID NO: 2622 |
| HSBP1 | NM_001537.1 | GGAGATGGCCGAGACTGACCCCAAGACCGTGCAGGACCTCACCTCGGTGGTGCAGACACTCCTGCAG | SEQ ID NO: 2623 |
| HSD17B1 | NM_000413.1 | CTGGACCGCACGGACATCCACACCTTCCACCGCTTCTACCAATACCTCGCCCACAGCAAGCAAGTCTTTCGCGAGGCG | SEQ ID NO: 2624 |
| HSD17B2 | NM_002153.1 | GCTTTCCAAGTGGGGAATTAAAGTTGCTTCCATCCAACCTGGAGGCTTCCTAACAAATATCGCAGGCA | SEQ ID NO: 2625 |
| HSPA1A | NM_005345.4 | CTGCTGCGACAGTCCACTACCTTTTTCGAGAGTGACTCCCGTTGTCCCAAGGCTTCCCAGAGCGAACCTG | SEQ ID NO: 2626 |
| HSPA1B | NM_005346.3 | GGTCCGCTTCGTCTTTCGAGAGTGACTCCCGCGGTCCCAAGGCTTTCCAGAGCGAACCTGTGC | SEQ ID NO: 2627 |
| HSPA4 | NM_002154.3 | TTCAGTGTGTCCAGTGCATCTTTAGTGGAGGTTCACAAGTCTGAGGAAAATGAGGAGCCAATGGAAACAGAT | SEQ ID NO: 2628 |
| HSPA5 | NM_005347.2 | GGCTAGTAGAACTGGATCCCAACACCAAACTCTTAATTAGACCTAGGCCTCAGCTGCACTGCCCGAAAAGCATTTGGGCAGACC | SEQ ID NO: 2629 |
| HSPA8 | NM_006597.3 | CCTCCCTCTGGTGGTGCTTCCTCAGGGCCCACCATTGAAGAGGTTGATTAAGCCAACCAAGTGTAGATGTAGC | SEQ ID NO: 2630 |
| HSPB1 | NM_001540.2 | CCGACTGGAGGAGCATAAAAGCGCAGCCGAGCCCAGCGCCCCGCACTTTTCTGAGCAGACGTCCAGAGCAGAGTCAGCCAGCAT | SEQ ID NO: 2631 |
| HSPCA | NM_005348.2 | CAAAAGGCAGAGGCTGATAAGAACGACAAGTCTGTGAAGGATCTGGTCATCTTGCTTTATGAAACTGCGCT | SEQ ID NO: 2632 |
| HSPE1 | NM_002157.1 | GCAAGCAACAGTAGTCGCTGTTGGATCGGGTTCTAAAGGAAAGGGTGGAGAGATTCAACCAGTTAGCGTGAAAGTTGG | SEQ ID NO: 2633 |

TABLE B-continued

| Gene | Locus Link | Sequence | SEQ ID NO |
|---|---|---|---|
| HSPG2 | NM_005529.2 | GAGTACGTGTGCCGAGTGTTGGGCAGCTCCGTGCCTCTAGAGGCCTCTGTCCTGGTCACCATTGAG | SEQ ID NO: 2634 |
| ICAM1 | NM_000201.1 | GCAGACAGTGACCATCTACAGCTTTCCGGCGCCCAACGTGATTCTGACGAAGCCAGAGGTCTCAGAAG | SEQ ID NO: 2635 |
| ICAM2 | NM_000873.2 | GGTCATCCTGACACTGCAACCCACTTTGGTGGCTGTGGGCAAGTCCTTCACCATTGAGTGCA | SEQ ID NO: 2636 |
| ID1 | NM_002165.1 | AGAACCGCAAGGTGAGCAAGGTGGAGATTCTCCAGCACGTCATCGACTACATCAGGGACCTTCAGTTGGA | SEQ ID NO: 2637 |
| ID2 | NM_002166.1 | AACGACTGCTACTCCAAGCTCAAGGAGCTGGTGCCCAGCATCCCCCAGAACAAGAAGGTGAGCAAGATGGAAATCC | SEQ ID NO: 2638 |
| ID3 | NM_002167.2 | CTTCACCAAATCCCTTCCTGGAGACTAAACCTGGTGCTCAGGAGCGAAGGACTGTGAACTTGTAGCCTGAAGAGCCAGAG | SEQ ID NO: 2639 |
| ID4 | NM_001546.2 | TGGCCTGGCTCTTAATTTGCTTTTGTTTTGCCCAGTATAGACTCGGAAGTAAGAGTTATAGCTAGTGGTCTTGCATGATTGCA | SEQ ID NO: 2640 |
| IFIT1 | NM_001548.1 | TGACAACCAAGCAAATGTGAGGAGTCTGGTGACCTGGGGCAACTTTGCCTGGATGTATTACCACATGGGCAGACTG | SEQ ID NO: 2641 |
| IGF1 | NM_000618.1 | TCCGGAGCTGTGATCTAAGGAGGCTGGAGATGTATTGCGCACCCCTCAAGCCTGCCAAGTCAGCTCGCTCTGTCCG | SEQ ID NO: 2642 |
| IGF1R | NM_000875.2 | GCATGGTAGCCGAAGATTTCACAGTCAAAATCGGAGATTTTGGTATGACGCGAGATATCTATGAGACAGACTATTACCGGAAA | SEQ ID NO: 2643 |
| IGF2 | NM_000612.2 | CCGTGCTTCCGGACAACTTCCCCAGATACCCCGTGGGCAAGTTCTTCCAATATGACACCTGGAAGCAGTCCA | SEQ ID NO: 2644 |
| IGFBP2 | NM_000597.1 | GTGGACAGCACCATGAACATGTTGGGCGGGGAGGCAGTGCTGGCCGGAAGCCCCTCAAGTCGGGTATGAAGG | SEQ ID NO: 2645 |
| IGFBP3 | NM_000598.1 | ACGCACCGGGTGTCTGATCCCAAGTTCCACCCCCTCCATTCAAAGATAATCATCATCAAGAAAGGGCA | SEQ ID NO: 2646 |
| IGFBP5 | NM_000599.1 | TGGACAAGTACGGGATGAAGCTGCCAGGCATGGAGTACGTTGACGGGGACTTTCAGTGCCACACCTTCG | SEQ ID NO: 2647 |
| IGFBP6 | NM_002178.1 | TGAACCGCAGAGACCAACAGAGGAATCCAGGCACCTCTACCACGCCCTCCCAGCCCAATTCTGCGGGTGTCCAAGAC | SEQ ID NO: 2648 |
| IGFBP7 | NM_001553 | GGGTCACTATGGAGTTCAAAGGACAGAACTCCTGCCTGGTGACCGGGACAACCTGGCCATTCAGACCC | SEQ ID NO: 2649 |
| IHH | NM_002181.1 | AAGGACGAGGAGAACACAGGCGCCGACCGCCTCATGACCCAGCGCTGCAAGGACCGCCTGAACTCGCTGGCTATCT | SEQ ID NO: 2650 |
| IL-8 | NM_000584.2 | AAGGAACCATCTCACTGTGTGTAAACATGACTTCCAAGCTGGCCGTGGCTCTCTTGGCAGCCTTCCTGAT | SEQ ID NO: 2651 |
| IL10 | NM_000572.1 | GGCGCTGTCATCGATTTCTTCCCTGTGAAAACAAGAGCAAGGCCGTGGAGCAGGTGAAGAATGCCTTTAATAAGCTCCA | SEQ ID NO: 2652 |

TABLE B-continued

| Gene | Locus Link | Sequence | SEQ ID NO |
|---|---|---|---|
| IL1B | NM_000576.2 | AGCTGAGGAAGATGCTGGTTCCCTGCCCACAGACCTTCCAGGAGAATGACCTGAGCACCTTCTTTCC | SEQ ID NO: 2653 |
| IL6 | NM_000600.1 | CCTGAACCTTCCAAAGATGGCTGAAAAAGATGGATGCTTCCAATCTGGATTCAATGAGGAGACTTGCCTGGT | SEQ ID NO: 2654 |
| IL6ST | NM_002184.2 | GGCCTAATGTTCCAGATCCTTCAAAGAGTCATATTGCCCAGTGGTCACCTCACACTCCTCCAAGGCACAATTTT | SEQ ID NO: 2655 |
| ILT-2 | NM_006669.1 | AGCCATCACTCTCAGTGCAGCCAGGTCCTATCGTGGCCCCTGAGGAGACCCTGACTCTGCAGT | SEQ ID NO: 2656 |
| IMP-1 | NM_006546.2 | GAAAGTGTTTGCGGAGCACAAGATCTCCTACAGCGGCCAGTTCTTGGTCAAATCCGGCTACGCCTTC | SEQ ID NO: 2657 |
| IMP2 | NM_006548.3 | CAATCTGATCCCAGGGTTGAACCTCAGCGCACTTGGCATCTTTTCAACAGGACTGTCCGTGCTATCTCCACCAGCAGGGCC | SEQ ID NO: 2658 |
| ING1L | NM_001564.1 | TGTTTCCAAGATCCTGCTGAAAGTGAACGAGCCTCAGATAAAGCAAAGATGGATTCCAGCCAACCAGAAAGA | SEQ ID NO: 2659 |
| ING5 | NM_032329.4 | CCTACAGCAAGTGCAAGGAATACAGTGACGACAAAGTGCAGCTGGCCATGCAGACCTACGAGATG | SEQ ID NO: 2660 |
| INHA | NM_002191.2 | CCTCCCAGTTTCATCTTCCACTACTGTCATGGTGGTTGTGGGCTGCAGATCCCACCAAACCTGTCCCTTCCAGTCCCT | SEQ ID NO: 2661 |
| INHBA | NM_002192.1 | GTGCCCGAGCCATATAGCAGGCACGTCCGGGTCCTCACTGTCCTTCCACTCAACAGTCATCAACCACTACCG | SEQ ID NO: 2662 |
| INHBB | NM_002193.1 | AGCCTCCAGGATACCAGCAAATGGATGCGGTGACAAATGGCAGCTTAGCTACAAATGCCTGTCAGTCGGAGA | SEQ ID NO: 2663 |
| IRS1 | NM_005544.1 | CCACAGCTCACCTTCTGTCAGGTGTCCATCCCAGCTCCAGCCAGCTCCCAGAGAGGAAGAGACTGGCACTGAGG | SEQ ID NO: 2664 |
| ITGA3 | NM_002204.1 | CCATGATCCTCACTCTGCTGGTGGACTATACACTCCAGACCTCGCTTAGCATGGTAAATCACCGGCTACAAAGCTTC | SEQ ID NO: 2665 |
| ITGA4 | NM_000885.2 | CAACGCTTCAGTGATCAATCCCGGGGCGATTTACAGATGCAGGATCGGAAAGAATCCCGGCCAGAC | SEQ ID NO: 2666 |
| ITGA5 | NM_002205.1 | AGGCCAGCCCTACATTATCAGAGCAAGAGCCGGATAGAGGACAAGGCTCAGATCTTGCTGGACTGTGGAGAAGAC | SEQ ID NO: 2667 |
| ITGA6 | NM_000210.1 | CAGTGACAAACAGCCCTTCCAACCCAAGGAATCCCACAAAAGATGGCGATGACGCCCATGAGGCTAAAC | SEQ ID NO: 2668 |
| ITGA7 | NM_002206.1 | GATATGATTGGTCGCTGCTTTGTGCTCAGCCAGGACCTGGCCATCCGGGATGAGTTGGATGGTGGGGAATGGAAGTTCT | SEQ ID NO: 2669 |
| ITGAV | NM_002210.2 | ACTCGGACTGCACAAGCTATTTTTGATGACAGCTATTTGGGTTATTCTGTGGCTGTCGGAGATTTCAATGGTGATGGCA | SEQ ID NO: 2670 |
| ITGB1 | NM_002211.2 | TCAGAATTGGATTTGGCTCATTTGTGGAAAAGACTGTGATGCCTTACATTAGCACAACACCAGCTAAGCTCAGG | SEQ ID NO: 2671 |

TABLE B-continued

| Gene | Locus Link | Sequence | SEQ ID NO |
|---|---|---|---|
| ITGB3 | NM_000212.1 | ACCGGGAGCCCTACATGACCGAAAATACCTGCAACCGTTACTGCCGTGACGAGATTGAGTCAGTGAAAGAGCTTAAGG | SEQ ID NO: 2672 |
| ITGB4 | NM_000213.2 | CAAGGTGCCCTCAGTGGAGCTCACCAACCTGTACCCGTATTGCGACTATGAGATGAAGGTGTGCGC | SEQ ID NO: 2673 |
| ITGB5 | NM_002213.3 | TCGTGAAAGATGACCAGGAGGCTGTGCTATGTTTCTACAAAACCGCCAAGGACTGCGTCATGATGTTCACC | SEQ ID NO: 2674 |
| K-ras | NM_033360.2 | GTCAAAATGGGGAGGGACTAGGGCAGTTTGGATAGCTCAACAAGATACAATCTCACTCTGTGGTGGTCCTG | SEQ ID NO: 2675 |
| KCNH2 iso a/b | NM_000238.2 | GAGCGCAAAGTGGAAATCGCCTTCTACCGGAAAGATGGGAGCTGCTTCCTATGTCTGGTGGATGTGGTGCCCGTGAAGA | SEQ ID NO: 2676 |
| KCNH2 iso a/c | NM_172057.1 | TCCTGCTGCTGGTCATCTACACGGCTGTCTTCACACCCTACTCGGCTGCCTTCCTGCTGAAGGAGACGGAAGAAGG | SEQ ID NO: 2677 |
| KCNK4 | NM_016611.2 | CCTATCAGCCGCTGGTGTGGTTCTGGATCCTGCTCGGCCTGGCTTACTTCGCCTCAGTGCTCACCACCA | SEQ ID NO: 2678 |
| KDR | NM_002253.1 | GAGGACGAAGGCCTCTACACCTGCCAGGCATGCAGTGTTCTTGGCTGTGCAAAAGTGGAGGCATTTTT | SEQ ID NO: 2679 |
| Ki-67 | NM_002417.1 | CGGACTTTGGGTGCGACTTGACGAGCGGTGGTTCGACAAGTGGCCTTGCGGGCCGGATCGTCCCAGTGGAAGAGTTGTAA | SEQ ID NO: 2680 |
| KIAA0125 | NM_014792.2 | GTGTCCTGGTCCATGTGGTGCACGTGTCTCCACCTCCAAGGAGAGGCTCCTCAGTGTGCACCTCCC | SEQ ID NO: 2681 |
| KIF22 | NM_007317.1 | CTAAGGCACTTGCTGGAAGGGCAGAATGCCAGTGTGCTTGCCTATGGACCCACAGGAGCTGGGAAGA | SEQ ID NO: 2682 |
| KIF2C | NM_006845.2 | AATTCCTGCTCCAAAAGAAAGTCTTCGAAGCCGCTCCACTCGCATGTCCACTGTCTCAGAGCTTCGCATCACG | SEQ ID NO: 2683 |
| KIFC1 | XM_371813.1 | CCACAGGGTTGAAGAACCAGAAGCCAGTTCCTGCTGTTCCTGTCCAGAAGTCTGGCACATCAGGTG | SEQ ID NO: 2684 |
| Kitlng | NM_000899.1 | GTCCCCGGGATGGATGTTTTGCCAAGTCATTGTTGGATAAGCGAGATGGTAGTACAATTGTCAGACAGCTTGACTGATC | SEQ ID NO: 2685 |
| KLF5 | NM_001730.3 | GTGCAACCGCAGCTTCTCGCGCTCTGACCACCTGGCCCTGCATATGAAGAGGCACCAGAACTGAGCACTGCCCG | SEQ ID NO: 2686 |
| KLF6 | NM_001300.4 | CACGAGACCGGCTACTTCTCGGCGCTGCCGTCTCTGGAGGAGTACTGGCAACAGACCTGCCTAGAGC | SEQ ID NO: 2687 |
| KLK10 | NM_002776.1 | GCCCAGAGGCTCCATCGTCCATCCTCTTCCTCCCCAGTCGGCTGAACTCTCCCCTTGTCTGCACTGTTCAAACCTCTG | SEQ ID NO: 2688 |
| KLK6 | NM_002774.2 | GACGTGAGGGTCCTGATTCTCCCTGGTTTTACCCCAGCTCCATCCTTGCATCACTGGGGAGGACGTGATGAGTGAGGA | SEQ ID NO: 2689 |
| KLRK1 | NM_007360.1 | TGAGAGCCAGGCTTCTTGTATGTCTCAAAATGCCAGCCTTCTGAAAGTATACAGCAAAGAGGACCAGGAT | SEQ ID NO: 2690 |

TABLE B-continued

| Gene | Locus Link | Sequence | SEQ ID NO |
|---|---|---|---|
| KNTC2 | NM_006101.1 | ATGTGCCAGTGAGCTTGAGTCCTTGGAGAAACACAAGCACCTGCTAGAAAGTACTGTTAACCAGGGGCTCA | SEQ ID NO: 2691 |
| KRAS2 | NM_004985.3 | GAGACCAAGGTTGCAAGGCCAGGCCCTGTGTGAACCTTTGAGCTTTCATAGAGAGTTTCACAGCATGGACTG | SEQ ID NO: 2692 |
| KRT19 | NM_002276.1 | TGAGCGGCAGAATCAGGAGTACCAGCGGCTCATGGACATCAAGTCGCGGCTGGAGCAGGAGATTGCCACCTACCGCA | SEQ ID NO: 2693 |
| KRT8 | NM_002273.1 | GGATGAAGCTTACATGAACAAGGTAGAGCTGGAGTCTCGCCTGGAAGGGCTGACCGACGAGATCAACTTCCTCAGGCAGCTATATG | SEQ ID NO: 2694 |
| LAMA3 | NM_000227.2 | CAGATGAGGCACATGGAGACCCAGGCCAAGGACCTGAGGAATCAGTTGCTCAACTACCGTTCTGCCATTTCAA | SEQ ID NO: 2695 |
| LAMB3 | NM_000228.1 | ACTGACCAAGCCTGAGACCTACTGCACCCAGTATGGCGAGTGGCAGATGAAATGCTGCAAGTGTGAC | SEQ ID NO: 2696 |
| LAMC2 | NM_005562.1 | ACTCAAGCGGAAATTGAAGCAGATAGGTCTTATCAGCACAGTCTCCGCCTCCTGGATTCAGTGTCTCGGCTTCAGGGAGT | SEQ ID NO: 2697 |
| LAT | NM_014387.2 | GTGAACGTTCCGGAGAGCGGGGAGAGCGCAGAAGCGTCTCTGGATGGCAGCCGGGAGTATGTGAATGT | SEQ ID NO: 2698 |
| LCN2 | NM_005564.2 | CGCTGGGCAACATTAAGAGTTACCCTGGATTAACGAGTTACCTCGTCCGAGTGGTGAGCACCAACTACAACCAGCATGCT | SEQ ID NO: 2699 |
| LDLRAP1 | NM_015627.1 | CAGTGCCTCTCGCCTGTCGACTGGGACAAGCCTGACAGCAGCGGCACAGAGCAGGATGACCTCTTCA | SEQ ID NO: 2700 |
| LEF | NM_016269.2 | GATGACGGAAAGCATCCAGATGGAGGCCTCTACAACAAGGGACCCTCCTACTCGAGTTATTCCGGG | SEQ ID NO: 2701 |
| LGALS3 | NM_002306.1 | AGCGGAAAATGGCAGACAATTTTTCGCTCCATGATGCGTTATCTGGGTCTGGAAACCCAAACCCTCAAG | SEQ ID NO: 2702 |
| LGMN | NM_001008530.1 | TTGGTGCCGTTCCTATAGATGATCCTGAAGATGGAGGCAAGCACTGGGTGGTGATCGTGGCAGGTTC | SEQ ID NO: 2703 |
| LILRB3 | NM_006864.1 | CACCTGGTCTGGGAAGATACCTGGAGGTTTTGATTGGGGTCTCGGTGGCCTTCGTCCTGCTGCTCTT | SEQ ID NO: 2704 |
| LMNB1 | NM_005573.1 | TGCAAACGCTGGTGTCACAGCCAGCCCCCCAACTGACCTCATCTGGAAGAACCAGAACTCGTGGGG | SEQ ID NO: 2705 |
| LMYC | NM_012421.1 | CCCATCCAGAACACTGATTGCTGTCATTCAAGTGAAAGGGATGGAGGTCAGAAAGGGTGCATAGAAAGCAG | SEQ ID NO: 2706 |
| LOX | NM_002317.3 | CCAATGGGAGAACAACGGGCAGGTGTTCAGCTTGCTGAGCCTGGGCTCACAGTACCAGCCTCAGCG | SEQ ID NO: 2707 |
| LOXL2 | NM_002318.1 | TCAGCGGGCTCTTAAACAACCAGCTGTCCCCGCAGTAAAGAAGCCTGCGTGGTCAACTCCTGTCTT | SEQ ID NO: 2708 |
| LRP5 | NM_002335.1 | CGACTATGACCCACTGGACAAGTTCATCTACTGGGTGGATGGGCGCCAGAACATCAAGCGAGCCAAG | SEQ ID NO: 2709 |

TABLE B-continued

| Gene | Locus Link | Sequence | SEQ ID NO |
|---|---|---|---|
| LRP6 | NM_002336.1 | GGATGTAGCCATCTCTGCCTCTATAGACCTCAGGGCCTTCGCTGTGCTTGCCCTATTGGCTTTGAACT | SEQ ID NO: 2710 |
| LY6D | NM_003695.2 | AATGCTGATGACTTGGAGCAGGCCCCACAGACCCCACAGAGGATGAAGCCACCCCACAGAGGATGCAG | SEQ ID NO: 2711 |
| MAD | NM_002357.1 | TGGTTCTGATTAGGTAACGTATTGGACCTGCCCACAACTCCCTTGCACGTAAACTTCAGTGTCCCACCTTGACC | SEQ ID NO: 2712 |
| MAD1L1 | NM_003550.1 | AGAAGCTGTCCCTGCAAGAGCAGGATGCAGCGATTGTGAAGAACATGAAGTCTGAGCTGGTACGGCT | SEQ ID NO: 2713 |
| MAD2L1 | NM_002358.2 | CCGGGAGCAGGGAATCACCCTGCGCGGGAGCGCCGAAATCGTGGCCGAGTTCTTCTCATTCGGCATCAACAGCAT | SEQ ID NO: 2714 |
| MADH2 | NM_005901.2 | GCTGCCTTTGGTAAGAACATGTCGTCCATCTTGCCATTCACGCCGCCAGTTGTGAAGAGACTGCTGGGAT | SEQ ID NO: 2715 |
| MADH4 | NM_005359.3 | GGACATTACTGGCCTGTTCACAATGAGCTTGCATTCCAGCCTCCCATTTCCAATCATCCTGCTCCTGAGTATTGGT | SEQ ID NO: 2716 |
| MADH7 | NM_005904.1 | TCCATCAAGGCTTTCGACTACGAGAAGGCGTACAGCCTGCAGCGGCCCAATGACCACGAGTTTATGCAGCAG | SEQ ID NO: 2717 |
| MAP2 | NM_031846.1 | CGGACCACCAGGTCAGAGCCAATTCGCAGAGCAGGGAAGAGTGGTACCTCAACACCCACTACCCCTG | SEQ ID NO: 2718 |
| MAP2K1 | NM_002755.2 | GCCTTTCTTACCCAGAAGCAGAAGGTGGGAGAACTGAAGGATGACGACTTTGAGAAGATCAGTGAGCTGGGGGCTG | SEQ ID NO: 2719 |
| MAP3K1 | XM_042066.8 | GGTTGGCATCAAAAGGAACTGGTGCAGGAGAGTTTCAGGGACAATTACTGGGGACAATTGCATTTATGGCA | SEQ ID NO: 2720 |
| MAPK14 | NM_139012.1 | TGAGTGGAAAAGCCTGACCTATGATGAAGTCATCAGCTTTGTGCCACCACCCCTTGACCAAGAAGAGATGGAGTCC | SEQ ID NO: 2721 |
| Maspin | NM_002639.1 | CAGATGGCCACTTTGAGAACATTTTAGCTGACAACAGTGTGAACGACCAGACCAAAATCCTTGTGGTTAATGCTGCC | SEQ ID NO: 2722 |
| MAX | NM_002382.3 | CAAACGGGCTCATCATAATGCACTGGAACGAAAACGTAGGGACCACATCAAAGACAGCTTTCACAGTTTGCGGGA | SEQ ID NO: 2723 |
| MCM2 | NM_004526.1 | GACTTTTGCCCGCTACCTTTCATTCCGGCGTGACAACAATGAGCTGTTGCTCTTCATACTGAAGCAGTTAGTGGC | SEQ ID NO: 2724 |
| MCM3 | NM_002388.2 | GGAGAACAATCCCCTTGAGACAGAATATGGCCTTTCTGTCTACAAGGATCACCAGACCATCACCATCCAGGAGAT | SEQ ID NO: 2725 |
| MCM6 | NM_005915.2 | TGATGGTCCTATGTGTCACATTCATCACAGGTTTCATACCAACACAGGCTTCAGCACTTCCTTTGGTGTGTTTCCTGTCCCA | SEQ ID NO: 2726 |
| MCP1 | NM_002982.1 | CGCTCAGCCAGATGCAATCAATGCCCCAGTCACCTGCTGTTATAACTTCACCAATAGGAAGATCTCAGTGC | SEQ ID NO: 2727 |
| MDK | NM_002391.2 | GGAGCCGACTGCAAGTACAAGTTTGAGAACTGGGGTGCGTGTGATGGGGGCACAGGCACCAAAGTC | SEQ ID NO: 2728 |

TABLE B-continued

| Gene | Locus Link | Sequence | SEQ ID NO |
|---|---|---|---|
| MDM2 | NM_002392.1 | CTACAGGGACGCCATCGAATCCGGATCTTGATGCTGGTGTAAGTGAACATTCAGGTGATTGG TTGGAT | SEQ ID NO: 2729 |
| MGAT5 | NM_002410.2 | GGAGTCGAAGGTGGACAATCTTGTTGTCAATGGCACCGGAACAAACTCAACCAACTCCACT ACAGCTGTTCCCA | SEQ ID NO: 2730 |
| MGMT | NM_002412.1 | GTGAAATGAAACGCACCACACTGGACAGCCCTTTGGGGAAGCTGGAGCTGTCTGGTTGTGA GCAGGGTC | SEQ ID NO: 2731 |
| mGST1 | NM_020300.2 | ACGGATCTACCACACCATTGCATATTTGACACCCCTTCCCCAGCCAAATAGAGCTTTGAGTT TTTTTGTTGGATATGGA | SEQ ID NO: 2732 |
| MMP1 | NM_002421.2 | GGGAGATCATCGGGACAACTCTCCTTTTGATGGACCTGGAGGAAATCTTGCTCATGCTTTTC AACCAGGCCC | SEQ ID NO: 2733 |
| MMP12 | NM_002426.1 | CCAACGCTTGCCAAATCCTGACAATTCAGAACCAGCTCTCTGTGACCCCAATTTGAGTTTTG ATGCTGTCACTACCGT | SEQ ID NO: 2734 |
| MMP2 | NM_004530.1 | CCATGATGGAGAGGCAGACATCATGATCAACTTTGGCCGCTGGGAGCATGGCGATGGATAC CCCTTTGACGGTAAGGACGGACTCC | SEQ ID NO: 2735 |
| MMP7 | NM_002423.2 | GGATGGTAGCAGTCTAGGGATTAACTTCCTGTATGCTGCAACTCATGAACTTGGCCATTCTTT GGGTATGGGACATTCC | SEQ ID NO: 2736 |
| MMP9 | NM_004994.1 | GAGAACCAATCTCACCGACAGGCAGCTGGCAGAGGAATACCTGTACCGCTATGGTTACACT CGGGTG | SEQ ID NO: 2737 |
| MRP1 | NM_004996.2 | TCATGGTGCCCGTCAATGCTGTGATGGCGATGAAGACCAAGACGTATCAGGTGGCCCACAT GAAGAGCAAAGACAATCG | SEQ ID NO: 2738 |
| MRP2 | NM_000392.1 | AGGGGATGACTTGGACACATCTGCCATTCGACATGACTGCAATTTTGACAAAGCCATGCAGT TTT | SEQ ID NO: 2739 |
| MRP3 | NM_003786.2 | TCATCCTGGCGATCTACTTCCTCTGGCAGAACCTAGGTCCCTCTGTCCTGGCTGGAGTCGCTT TCATGGTCTTGCTGATTCCACTCAACGG | SEQ ID NO: 2740 |
| MRP4 | NM_005845.1 | AGCGCCTGGAATCTACAACTCGGAGTCCAGTGTTTTCCCACTTGTCATCTTCTCTCCAGGGGC TCT | SEQ ID NO: 2741 |
| MRPL40 | NM_003776.2 | ACTTGCAGGCTGCTATCCTTAACATGCTGCCCCTGAGAGTAGGAATGACCAGGGTTCAAGTC TGCT | SEQ ID NO: 2742 |
| MSH2 | NM_000251.1 | GATGCAGAATTGAGGCAGACTTTACAAGAAGATTTACTTCGTCGATTCCCAGATCTTAACCG ACTTGCCAAGA | SEQ ID NO: 2743 |
| MSH3 | NM_002439.1 | TGATTACCATCATGGCTCAGATTGGCTCCTATGTTCCTGCAGAAGAAGCGACAATTGGGATT GTGGATGGCATTTTCACAAG | SEQ ID NO: 2744 |
| MSH6 | NM_000179.1 | TCTATTGGGGATTGGTAGGAACCGTTACCAGCTGGAAATTCCTGAGAATTTCACCACTCGC AATTTG | SEQ ID NO: 2745 |
| MT3 | NM_005954.1 | GTGTGAGAAGTGTGCCAAGGACTGTGTGTGCAAAGGCGGAGAGGCAGCTGAGGCAGAAGC AGAGAAGTGCAG | SEQ ID NO: 2746 |
| MTA1 | NM_004689.2 | CCGCCCTCACCTGAAGAGAAACGCGCTCCTTGGCGGACACTGGGGAGGAGAGGAAGAAGC GCGGCTAACTTATTCC | SEQ ID NO: 2747 |

TABLE B-continued

| Gene | Locus Link | Sequence | SEQ ID NO |
|---|---|---|---|
| MUC1 | NM_002456.1 | GGCCAGGATCTGTGGTGGTACAATTGACTCTGGCCTTCCGAGAAGGTACCATCAATGTCCACGACGTGGAG | SEQ ID NO: 2748 |
| MUC2 | NM_002457.1 | CTATGAGCCATGTGGGAACCGGAGCTTCGAGACCTGCAGGACCATCAACGGCATCCACTCCAACAT | SEQ ID NO: 2749 |
| MUC5B | XM_039877.11 | TGCCCTTGCACTGTCCTAACGGCTCAGCCATCCTGCACACCTACACCCACGTGGATGAGTGTGGCTG | SEQ ID NO: 2750 |
| MUTYH | NM_012222.1 | GTACGACCAAGAGAAACGGGACCTACCATGGAGAAGACGGGCAGAAGATGAGATGGACCTGGACAGG | SEQ ID NO: 2751 |
| MVP | NM_017458.1 | ACGAGAACGAGGGCATCTATGTGCAGGATGTCAAGACCGGAAAGGTGCGCGCTGTGATTGGAAGCACCTACATGC | SEQ ID NO: 2752 |
| MX1 | NM_002462.2 | GAAGGAATGGGAATCAGTCATGAGCTAATCACCCTGGAGATCAGCTCCCGAGATGTCCCGGATCTGACTCTAATAGAC | SEQ ID NO: 2753 |
| MXD4 | NM_006454.2 | AGAAACTGGAGGAGCAGGACCGCCGGGCACTGAGCATCAAGGAGCAGCTGCAGCAGGAGCATCGTTTCCTGAAG | SEQ ID NO: 2754 |
| MYBL2 | NM_002466.1 | GCCGAGATCGCCAAGATGTTGCCAGGGAGGACAGACAATGCTGTGAAGAATCACTGGAACTCTACCATCAAAAG | SEQ ID NO: 2755 |
| MYH11 | NM_002474.1 | CGGTACTTCTCAGGGCTAATATATACGTACTCTGGCCTCTTCTGCGTGGTGGTCAACCCCTATAAACACCTGCCCATCTACTCGG | SEQ ID NO: 2756 |
| MYLK | NM_053025.1 | TGACGGAGCGTGAGTGCATCAAGTACATGCGGCAGATCTCGGAGGGAGTGGAGTACATCCACAAGCAGGGCAT | SEQ ID NO: 2757 |
| NAT2 | NM_000015.1 | TAACTGACATTCTTGAGCACCAGATCCGGGCTGTTCCCTTTGAGAACCTTAACATGCATTGTGGGCAAGCCAT | SEQ ID NO: 2758 |
| NAV2 | NM_182964.3 | CTCTCCCAGCACAGCTTGAACCTCACTGAGTCAACCAGCCTGGACATGTTGCTGGATGACACTGGTG | SEQ ID NO: 2759 |
| NCAM1 | NM_000615.1 | TAGTTCCCAGCTGACCATCAAAAAGGTGGATAAGAACGACGAGGCTGAGTACATCTGCATTGCTGAGAACAAGGCTG | SEQ ID NO: 2760 |
| NDE1 | NM_017668.1 | CTACTGCGGAAAGTCGGGGCACTGGAGTCCAAACTCGCTTCCTGCCGGAACCTCGTGTACGATCAGTCC | SEQ ID NO: 2761 |
| NDRG1 | NM_006096.2 | AGGGCAACATTCCACAGCTGCCCTGGCTGTGATGAGTGTCCTTGCAGGGGCCGGAGTAGGAGCACTG | SEQ ID NO: 2762 |
| NDUFS3 | NM_004551.1 | TATCCATCCTGATGGCGTCATCCCAGTGCTGACTTTCCTCAGGGATCACACCAATGCACAGTTCAA | SEQ ID NO: 2763 |
| NEDD8 | NM_006156.1 | TGCTGGCTACTGGGTGTTAGTTTGCAGTCCTGTGTGCTTCCCTCTCTTATGACTGTGTCCCTGGTTGTC | SEQ ID NO: 2764 |
| NEK2 | NM_002497.1 | GTGAGGCAGCGCGACTCTGGCGACTGGCCGGCCATGCCTTCCCGGGCTGAGGACTATGAAGTGTTGTACACCATTGGCA | SEQ ID NO: 2765 |
| NF2 | NM_000268.2 | ACTCCAGAGCTGACCTCCACCGCCCAGCCTGGGAAGTCATTGTAGGGAGTGAGACACTGAAGCCCTGA | SEQ ID NO: 2766 |

TABLE B-continued

| Gene | Locus Link | Sequence | SEQ ID NO |
|---|---|---|---|
| NFKBp50 | NM_003998.1 | CAGACCAAGGAGATGGACCTCAGCGTGGTGCGGCTCATGTTTACAGCTTTTCTTCCGGATAG CACTGGCAGCT | SEQ ID NO: 2767 |
| NFKBp65 | NM_021975.1 | CTGCCGGGATGGCTTCTATGAGGCTGAGCTCTGCCCGGACCGCTGCATCCACAGTTTCCAGA ACCTGG | SEQ ID NO: 2768 |
| NISCH | NM_007184.1 | CCAAGGAATCATGTTCGTTCAGGAGGAGGCCCTGGCCAGCAGCCTCTCGTCCACTGACAGTC TGACTCCCGAGCACCA | SEQ ID NO: 2769 |
| Nkd-1 | NM_033119.3 | GAGAGAGTGAGCGAACCCTGCCCAGGCTCCAAGAAGCAGCTGAAGTTTGAAGAGCTCCAGT GCGACG | SEQ ID NO: 2770 |
| NMB | NM_021077.1 | GGCTGCTGGTACAAATACTGCAGAAATGACACCAATAATAGGGGCAGACACAACAGCGTGG CTTAGATTG | SEQ ID NO: 2771 |
| NMBR | NM_002511.1 | TGATCCATCTCTAGGCCACATGATTGTCACCTTAGTTGCCCGGGTTCTCAGTTTTGGCAATTC TTGTGTCAACCCATTTGCTC | SEQ ID NO: 2772 |
| NME1 | NM_000269.1 | CCAACCCTGCAGACTCCAAGCCTGGGACCATCCGTGGAGACTTCTGCATACAAGTTGGCAGG AACATTATACAT | SEQ ID NO: 2773 |
| NOS3 | NM_000603.2 | ATCTCCGCCTCGCTCATGGGCACGGTGATGGCGAAGCGAGTGAAGGCGACAATCCTGTATG GCTCCGA | SEQ ID NO: 2774 |
| NOTCH1 | NM_017617.2 | CGGGTCCACCAGTTTGAATGGTCAATGCGAGTGGCTGTCCCGGCTGCAGAGCGGCATGGTGC CGAACCAATACAAC | SEQ ID NO: 2775 |
| NOTCH2 | NM_024408.2 | CACTTCCCTGCTGGGATTATATCAACAACCAGTGTGATGAGCTGTGCAACACGGTCGAGTGC CTGTTTGACAACT | SEQ ID NO: 2776 |
| NPM1 | NM_002520.2 | AATGTTGTCCAGGTTCTATTGCCAAGAATGTGTTGTCCAAAATGCCTGTTTAGTTTTTAAAGA TGGAACTCCACCCTTTGCTTG | SEQ ID NO: 2777 |
| NR4A1 | NM_002135.2 | CACAGCTTGCTTGTCGATGTCCCTGCCTTCGCCTGCCTCTCTGCCCTTGTCCTCATCACCGAC CGGCAT | SEQ ID NO: 2778 |
| NRG1 | NM_013957.1 | CGAGACTCTCCTCATAGTGAAAGGTATGTGTCAGCCATGACCACCCCGGCTCGTATGTCACC TGTAGATTTCCACACGCCAAG | SEQ ID NO: 2779 |
| NRP1 | NM_003873.1 | CAGCTCTCTCCACGCGATTCATCAGGATCTACCCCGAGAGAGCCACTCATGGCGGACTGGGG CTCAGAATGGAGCTGCTGGG | SEQ ID NO: 2780 |
| NRP2 | NM_003872.1 | CTACAGCCTAAACGGCAAGGACTGGGAATACATTCAGGACCCCAGGACCCAGCAGCCAAAG CTGTTCGAAGGGAAC | SEQ ID NO: 2781 |
| NTN1 | NM_004822.1 | AGAAGGACTATGCCGTCCAGATCCACATCCTGAAGGCGGACAAGGCGGGGACTGGTGGAA GTTCACGG | SEQ ID NO: 2782 |
| NUFIP1 | NM_012345.1 | GCTTCCACATCGTGGTATTGGAGACAGTCTTCTGATAGGTTTCCTCGGCATCAGAAGTCCTTC AACCCTGCAGTT | SEQ ID NO: 2783 |
| ODC1 | NM_002539.1 | AGAGATCACCGGCGTAATCAACCCAGCGTTGGACAAATACTTTCCGTCAGACTCTGGAGTGA GAATCATAGCTGAGCCCG | SEQ ID NO: 2784 |
| OPN, osteopontin | NM_000582.1 | CAACCGAAGTTTTCACTCCAGTTGTCCCCACAGTAGACACATATGATGGCCGAGGTGATAGT GTGGTTTATGGACTGAGG | SEQ ID NO: 2785 |

TABLE B-continued

| Gene | Locus Link | Sequence | SEQ ID NO |
|---|---|---|---|
| ORC1L | NM_004153.2 | TCCTTGACCATACCGGAGGGTGCATGTACATCTCCGGTGTCCCTGGGACAGGGAAGACTGCCACTG | SEQ ID NO: 2786 |
| OSM | NM_020530.3 | GTTTCTGAAGGGGAGGTCACAGCCTGAGCTGGCCTCCTATGCCTCATCATGTCCCAAACCAGACACCT | SEQ ID NO: 2787 |
| OSMR | NM_003999.1 | GCTCATCATGGTCATGTGCTACTTGAAAAGTCAGTGGATCAAGGAGACCTGTTATCCTGACATCCCTGACCCTTACA | SEQ ID NO: 2788 |
| P14ARF | S78535.1 | CCCTCGTGCTGATGCTACTGAGGAGCCAGCGTCTAGGGCAGCAGCCGCTTCCTAGAAGACCAGGTCATGATG | SEQ ID NO: 2789 |
| p16-INK4 | L27211.1 | GCGGAAGGTCCCTCAGACATCCCCGATTGAAAGAACCAGAGAGGCTCTGAGAAACCTCGGGAAACTTAGATCATCA | SEQ ID NO: 2790 |
| p21 | NM_000389.1 | TGGAGACTCTCAGGGTCGAAAACGGCGGCAGACCAGCATGACAGATTTCTACCACTCCAAACGCC | SEQ ID NO: 2791 |
| p27 | NM_004064.1 | CGGTGGACCACGAAGAGTTAACCCGGGACTTGGAGAAGCACTGCAGAGACATGGAAGAGGCGAGCC | SEQ ID NO: 2792 |
| P53 | NM_000546.2 | CTTTGAACCCTTGCTTGCAATAGGTGTGCGTCAGAAGCACCCAGGACTTCCATTTGCTTTGTCCCGGG | SEQ ID NO: 2793 |
| p53R2 | AB036063.1 | CCCAGCTAGTGTTCCTCAGAACAAAGATTGGAAAAAGCTGGCCGAGAACCATTTATACATAGAGGAAGGGCTTACGG | SEQ ID NO: 2794 |
| PADI4 | NM_012387.1 | AGCAGTGGCTTGCTTTCTTCTCCTGTGATGTCCCAGTTTCCCACTCTGAAGATCCCAACATGGTCCTAGCA | SEQ ID NO: 2795 |
| PAI1 | NM_000602.1 | CCGCAACGTGGTTTTCTCACCCTATGGGGTGGCCTCGGTGTTGGCCATGCTCCAGCTGACAACAGGAGGAGAAACCCAGCA | SEQ ID NO: 2796 |
| Pak1 | NM_002576.3 | GAGCTGTGGGTTGTTATGGAATACTTGGCTGGAGGCTCCTTGACAGATGTGGTGACAGAAACTTGCATGG | SEQ ID NO: 2797 |
| PARC | NM_015089.1 | GGAGCTGACCTGCTTCCTACATCGCCTGGCCTCGATGCATAAGGACTATGCTGTGGTGCTCTGCT | SEQ ID NO: 2798 |
| PCAF | NM_003884.3 | AGGTGGCTGTGTTACTGCAACGTGCCACAGTTCTGCGACAGTCTACCTCGGTACGAAACCACACAGGTG | SEQ ID NO: 2799 |
| PCNA | NM_002592.1 | GAAGGTGTTGGAGGCACTCAAGGACCTCATCAACGAGGCCTGCTGGGATATTAGCTCCAGCGGTGTAAACC | SEQ ID NO: 2800 |
| PDGFA | NM_002607.2 | TTGTTGGTGTGCCCTGGTGCCGTGGTGGCGGTCACTCCCTCTGCTGCCAGTGTTTGGACAGAACCCA | SEQ ID NO: 2801 |
| PDGFB | NM_002608.1 | ACTGAAGGAGACCCTTGGAGCCTAGGGGCATCGGCAGGAGAGTGTGTGGGCAGGGTTATTTA | SEQ ID NO: 2802 |
| PDGFC | NM_016205.1 | AGTTACTAAAAATACCACGAGGTCCTTCAGTTGAGACCAAAGACCGGTGTCAGGGGATTGCACAAATCACTCACCGAC | SEQ ID NO: 2803 |
| PDGFD | NM_025208.2 | TATCGAGGCAGGTCATACCATGACCGGAAGTCAAAAGTTGACCTGGATAGGCTCAATGATGATGCCAAGCGTTA | SEQ ID NO: 2804 |

TABLE B-continued

| Gene | Locus Link | Sequence | SEQ ID NO |
|---|---|---|---|
| PDGFRa | NM_006206.2 | GGGAGTTTCCAAGAGATGGACTAGTGCTTGGTCGGGTCTTGGGGTCTGGAGCGTTTGGGAAG GTGGTTGAAG | SEQ ID NO: 2805 |
| PDGFRb | NM_002609.2 | CCAGCTCTCCTTCCAGCTACAGATCAATGTCCCTGTCCGAGTGCTGGAGCTAAGTGAGAGCC ACCC | SEQ ID NO: 2806 |
| PFN1 | NM_005022.2 | GGAAAACGTTCGTCAACATCACGCCAGCTGAGGTGGGTGTCCTGGTTGGCAAAGACCGGTC AAGTTTT | SEQ ID NO: 2807 |
| PFN2 | NM_053024.1 | TCTATACGTCGATGGTGACTGCACAATGGACATCCGGACAAAGAGTCAAGGTGGGGAGCCA ACATACAATGTGGCTGTCGGC | SEQ ID NO: 2808 |
| PGK1 | NM_000291.1 | AGAGCCAGTTGCTGTAGAACTCAAATCTCTGCTGGGCAAGGATGTTCTGTTCTTGAAGGACT GTGTAGGCCCAG | SEQ ID NO: 2809 |
| PI3K | NM_002646.2 | TGCTACCTGGACAGCCCGTTGGTGCGCTTCCTCCTGAAACGAGCTGTGTCTGACTTGAGAGT GACTCACTACTTCTTCTGGTTACTGAAGGACGGCCT | SEQ ID NO: 2810 |
| PI3KC2A | NM_002645.1 | ATACCAATCACCGCACAAACCCAGGCTATTTGTTAAGTCCAGTCACAGCGCAAAGAAACAT ATGCGGAGAAAATGCTAGTGTG | SEQ ID NO: 2811 |
| PIK3CA | NM_006218.1 | GTGATTGAAGAGCATGCCAATTGGTCTGTATCCCGAGAAGCAGGATTTAGCTATTCCCACGC AGGAC | SEQ ID NO: 2812 |
| PIM1 | NM_002648.2 | CTGCTCAAGGACACCGTCTACACGGACTTCGATGGGACCCGAGTGTATAGCCCTCCAGAGTG GATCC | SEQ ID NO: 2813 |
| Pin1 | NM_006221.1 | GATCAACGGCTACATCCAGAAGATCAAGTCGGGAGAGGAGGACTTTGAGTCTCTGGCCTCA CAGTTCA | SEQ ID NO: 2814 |
| PKD1 | NM_000296.2 | CAGCACCAGCGATTACGACGTTGGCTGGAGAGTCCTCACAATGGCTCGGGACGTGGGCC TATTCAG | SEQ ID NO: 2815 |
| PKR2 | NM_002654.3 | CCGCCTGGACATTGATTCACCACCCATCACAGCCCGGAACACTGGCATCATCTGTACCATTG GCCCAG | SEQ ID NO: 2816 |
| PLA2G2A | NM_000300.2 | GCATCCCTCACCCATCCTAGAGGCCAGGCAGGAGCCCTTCTATACCCACCCAGAATGAGACA TCCAGCAGATTTCCAGC | SEQ ID NO: 2817 |
| PLAUR | NM_002659.1 | CCCATGGATGCTCCTCTGAAGAGACTTTCCTCATTGACTGCCGAGGCCCCATGAATCAATGT CTGGTAGCCACCGG | SEQ ID NO: 2818 |
| PLK | NM_005030.2 | AATGAATACAGTATTCCCAAGCACATCAACCCCGTGGCCGCCTCCCTCATCCAGAAGATGCT TCAGACA | SEQ ID NO: 2819 |
| PLK3 | NM_004073.2 | TGAAGGAGACGTACCGCTGCATCAAGCAGGTTCACTACACGCTGCCTGCCAGCCTCTCACTG CCTG | SEQ ID NO: 2820 |
| PLOD2 | NM_000935.2 | CAGGGAGGTGGTTGCAAATTTCTAAGGTACAATTGCTCTATTGAGTCACCACGAAAAGGCTG GAGCTTCATGCATCCTGGGAGA | SEQ ID NO: 2821 |
| PMS1 | NM_000534.2 | CTTACGGTTTTCGTGGAAGCCTTGGGGTCAATTTGTTGTATAGCTGAGGTTTTAATTACAA CAAGAACGGCTGCT | SEQ ID NO: 2822 |
| PMS2 | NM_000535.2 | GATGTGGACTGCCATTCAAACCAGGAAGATACCGGATGTAAATTTCGAGTTTTGCCTCAGCC AACTAATCTCGCA | SEQ ID NO: 2823 |

TABLE B-continued

| Gene | Locus Link | Sequence | SEQ ID NO |
|---|---|---|---|
| PPARG | NM_005037.3 | TGACTTTATGGAGCCCAAGTTTGAGTTTGCTGTGAAGTTCAATGCACTGGAATTAGATGACA GCGACTTGGC | SEQ ID NO: 2824 |
| PPID | NM_005038.1 | TCCTCATTTGGATGGGAAACATGTGGTGTTTGGCCAAGTAATTAAAGGAATAGGAGTGGCA AGGATATTGG | SEQ ID NO: 2825 |
| PPM1D | NM_003620.1 | GCCATCCGCAAAGGCTTTCTCGCTTGTCACCTTGCCATGTGGAAGAAACTGGCGGAATGGCC | SEQ ID NO: 2826 |
| PPP2R4 | NM_178001.1 | GGCTCAGAGCATAAGGCTTCAGGGCCCAAGTTGGGAGAAGTGACCAAAGTGTAGCCAGTTT TCTGAGTTCCCGT | SEQ ID NO: 2827 |
| PR | NM_000926.2 | GCATCAGGCTGTCATTATGGTGTCCTTACCTGTGGGAGCTGTAAGGTCTTCTTTAAGAGGGC AATGGAAGGGCAGCACAACTACT | SEQ ID NO: 2828 |
| PRDX2 | NM_005809.4 | GGTGTCCTTCGCCAGATCACTGTTAATGATTTGCCTGTGGGACGCTCCGTGGATGAGGCTCT GCGGCTG | SEQ ID NO: 2829 |
| PRDX3 | NM_006793.2 | TGACCCCAATGGAGTCATCAAGCATTTGAGCGTCAACGATCTCCCAGTGGGCCGAAGCGTG GAAGAAACCCTCCGCTTGG | SEQ ID NO: 2830 |
| PRDX4 | NM_006406.1 | TTACCCATTTGGCCTGGATTAATACCCCTCGAAGACAAGGAGGACTTGGGCCAATAAGGATT CCACTTCTTTCAG | SEQ ID NO: 2831 |
| PRDX6 | NM_004905.2 | CTGTGAGCCAGAGGATGTCAGCTGCCAATTGTGTTTTCCTGCAGCAATTCCATAAACACATC CTGGTGTCATCACA | SEQ ID NO: 2832 |
| PRKCA | NM_002737.1 | CAAGCAATGCGTCATCAATGTCCCCAGCCTCTGCGGAATGGATCACACTGAGAAGAGGGGG CGGATTTAC | SEQ ID NO: 2833 |
| PRKCB1 | NM_002738.5 | GACCCAGCTCCACTCCTGCTTCCAGACCATGGACCGCCTGTACTTTGTGATGGAGTACGTGA ATGGG | SEQ ID NO: 2834 |
| PRKCD | NM_006254.1 | CTGACACTTGCCGCAGAGAATCCCTTTCTCACCCACCTCATCTGCACCTTCCAGACCAAGGA CCACCT | SEQ ID NO: 2835 |
| PRKR | NM_002759.1 | GCGATACATGAGCCCAGAACAGATTTCTTCGCAAGACTATGGAAAGGAAGTGGACCTCTAC GCTTTGGGGCTAATTCTTGCTGA | SEQ ID NO: 2836 |
| pS2 | NM_003225.1 | GCCCTCCCAGTGTGCAAATAAGGGCTGCTGTTTCGACGACACCGTTCGTGGGGTCCCCTGGT GCTTCTATCCTAATACCATCGACG | SEQ ID NO: 2837 |
| PTCH | NM_000264.2 | CCACGACAAAGCCGACTACATGCCTGAAACAAGGCTGAGAATCCCGGCAGCAGAGCCCATC GAGTA | SEQ ID NO: 2838 |
| PTEN | NM_000314.1 | TGGCTAAGTGAAGATGACAATCATGTTGCAGCAATTCACTGTAAAGCTGGAAAGGGACGAA CTGGTGTAATGATATGTGCA | SEQ ID NO: 2839 |
| PTGER3 | NM_000957.2 | TAACTGGGGCAACCTTTTCTTCGCCTCTGCCTTTGCCTTCCTGGGGCTCTTGGCGCTGACAGT CACCTTTTCCTGCAA | SEQ ID NO: 2840 |
| PTHLH | NM_002820.1 | AGTGACTGGGAGTGGGCTAGAAGGGGACCACCTGTCTGACACCTCCACAACGTCGCTGGAG CTCGATTCACGGTAACAGGCTT | SEQ ID NO: 2841 |
| PTHR1 | NM_000316.1 | CGAGGTACAAGCTGAGATCAAGAAATCTTGGAGCCGCTGGACACTGGCACTGGACTTCAAG CGAAAGGCACGC | SEQ ID NO: 2842 |

TABLE B-continued

| Gene | Locus Link | Sequence | SEQ ID NO |
|---|---|---|---|
| PTK2 | NM_005607.3 | GACCGGTCGAATGATAAGGTGTACGAGAATGTGACGGGCCTGGTGAAAGCTGTCATCGAGATGTCCAG | SEQ ID NO: 2843 |
| PTK2B | NM_004103.3 | CAAGCCCAGCCGACCTAAGTACAGACCCCCTCCGCAAACCAACCTCCTGGCTCCAAAGCTGCAGTTCCAGGTTC | SEQ ID NO: 2844 |
| PTP4A3 | NM_007079.2 | AATATTTGTGCGGGGTATGGGGGTGGGTTTTTAAATCTCGTTTCTCTTGGACAAGCACAGGGATCTCGTT | SEQ ID NO: 2845 |
| PTP4A3 v2 | NM_032611.1 | CCTGTTCTCGGCACCTTAAATTATTAGACCCCGGGGCAGTCAGGTGCTCCGGACACCCGAAGGCAATA | SEQ ID NO: 2846 |
| PTPD1 | NM_007039.2 | CGCTTGCCTAACTCATACTTTCCCGTTGACACTTGATCCACGCAGCGTGGCACTGGGACGTAAGTGGCGCAGTCTGAATGG | SEQ ID NO: 2847 |
| PTPN1 | NM_002827.2 | AATGAGGAAGTTTCGGATGGGGCTGATCCAGACAGCCGACCAGCTGCGCTTCTCCTACCTGGCTGTGATCGAAG | SEQ ID NO: 2848 |
| PTPRF | NM_002840.2 | TGTTTTAGCTGAGGGACGTGGTGCCGACGTCCCCAAACCTAGCTAGGCTAAGTCAAGATCAACATTCCAGGGTTGGTA | SEQ ID NO: 2849 |
| PTPRJ | NM_002843.2 | AACTTCCGGTACCTCGTTCGTGACTACATGAAGCAGAGTCCTCCCGAATCGCCGATTCTGGTGCATTGCAGTGCT | SEQ ID NO: 2850 |
| PTPRO | NM_030667.1 | CATGGCCTGATCATGGTGTGCCCACAGCAAATGCTGCAGAAAGTATCCTGCAGTTTGTACACATGG | SEQ ID NO: 2851 |
| PTTG1 | NM_004219.2 | GGCTACTCTGATCTATGTTGATAAGGAAAATGGAGAACCAGGCACCCGTGTGGTTGCTAAGGATGGGCTGAAGC | SEQ ID NO: 2852 |
| RAB32 | NM_006834.2 | CCTGCAGCTGTGGGACATCGCGGGGCAGGAGCGATTTGGCAACATGACCCGAGTATACTACAAGGAAGCTGTTGGTGCT | SEQ ID NO: 2853 |
| RAB6C | NM_032144.1 | GCGACAGCTCCTCTAGTTCCACCATGTCCGCGGGCGGAGACTTCGGGAATCCGCTGAGGAAATTCAAGCTGGTGTTCC | SEQ ID NO: 2854 |
| RAC1 | NM_006908.3 | TGTTGTAAATGTCTCAGCCCCTCGTTCTTGGTCCTGTCCCTTGGAACCTTTGTACGCTTTGCTCAA | SEQ ID NO: 2855 |
| RAD51C | NM_058216.1 | GAACTTCTTGAGCAGGAGCATACCCAGGGCTTCATAATCACCTTCTGTTCAGCACTAGATGATATTCTTGGGGGTGGA | SEQ ID NO: 2856 |
| RAD54L | NM_003579.2 | AGCTAGCCTCAGTGACACACATGACAGGTTGCACTGCCGACGTTGTGTCAACAGCCGTCAGATCCGG | SEQ ID NO: 2857 |
| RAF1 | NM_002880.1 | CGTCGTATGCGAGAGTCTGTTTCCAGGATGCCTGTTAGTTCTCAGCACAGATATTCTACACCTCACGCCTTCA | SEQ ID NO: 2858 |
| RALBP1 | NM_006788.2 | GGTGTCAGATATAAATGTGCAAATGCCTTCTTGCTGTCCTGTCGGTCTCAGTACGTTCACTTTATAGCTGCTGGCAATATCGAA | SEQ ID NO: 2859 |
| RANBP2 | NM_006267.3 | TCCTTCAGCTTTCACACTGGGCTCAGAAATGAAGTTGCATGACTCTTCTGGAAGTCAGGTGGGAACAGGATTT | SEQ ID NO: 2860 |
| ranBP7 | NM_006391.1 | AACATGATTATCCAAGCCGCTGGACTGCCATTGTGGACAAAATTGGCTTTTATCTTCAGTCCGATAACAGTGCTTGTTGGC | SEQ ID NO: 2861 |

TABLE B-continued

| Gene | Locus Link | Sequence | SEQ ID NO |
|---|---|---|---|
| RANBP9 | NM_005493.2 | CAAGTCAGTTGAGACGCCAGTTGTGTGGAGGAAGTCAGGCCGCCATAGAAAGAATGATCCACTTTGGACGAGAGCTGCA | SEQ ID NO: 2862 |
| RAP1GDS1 | NM_021159.3 | TGTGGATGCTGGATTGATTTCACCACTGGTGCAGCTGCTAAATAGCAAAGACCAGGAAGTGCTGCTT | SEQ ID NO: 2863 |
| RARA | NM_000964.1 | AGTCTGTGAGAAACGACCGAAACAAGAAGAAGAAGGAGGTGCCCAAGCCCGAGTGCTCTGAGAGCTACACGCTGACGCCG | SEQ ID NO: 2864 |
| RARB | NM_016152.2 | TGCCTGGACATCCTGATTCTTAGAATTTGCACCAGGTATACCCCAGAACAAGACACCATGACTTTCTCAGACGGCCTT | SEQ ID NO: 2865 |
| RASSF1 | NM_007182.3 | AGTGGGAGACACCTGACCTTTCTCAAGCTGAGATTGAGCAGAAGATCAAGGAGTACAATGCCCAGATCA | SEQ ID NO: 2866 |
| RBM5 | NM_005778.1 | CGAGAGGGAGAGCAAGACCATCATGCTGCGCGGCCTTCCCATCACCATCACAGAGAGCGATATTCGAGA | SEQ ID NO: 2867 |
| RBX1 | NM_014248.2 | GGAACCACATTATGGATCTTTGCATAGAATGTCAAGCTAACCAGGCGTCCGCTACTTCAGAAGAGTGTACTGTCGCATG | SEQ ID NO: 2868 |
| RCC1 | NM_001269.2 | GGGCTGGGTGAGAATGTGATGGAGAGGAAGAAGCCGGCCCTGGTATCCATTCCGGAGGATGTTGTG | SEQ ID NO: 2869 |
| REG4 | NM_032044.2 | TGCTAACTCCTGCACAGCCCCGTCCTCTTCCTTTCTGCTAGCCTGGCTAAATCTGCTCATTATTTCAGAGGGGAAACCTAGCA | SEQ ID NO: 2870 |
| RFC | NM_003056.1 | TCAAGACCATCATCACTTTCATTGTCTCGGACGTGCGGGGCCTGGGCCTCCCGGTCCGCAAGCAGTTCCAGTTATACTCCGTGTACTTCCTGATCC | SEQ ID NO: 2871 |
| RhoB | NM_004040.2 | AAGCATGAACAGGACTTGACCATCTTTCCAACCCCTGGGGAAGACATTTGCAACTGACTTGGGGAGG | SEQ ID NO: 2872 |
| rhoC | NM_175744.1 | CCCGTTCGGTCTGAGGAAGGCCGGGACATGGCGAACCGGATCAGTGCCTTTGGCTACCTTGAGTGCTC | SEQ ID NO: 2873 |
| RIZ1 | NM_012231.1 | CCAGACGAGCGATTAGAAGCGGCAGCTTGTGAGGTGAATGATTTGGGGGAAGAGGAGGAGGAGGAAGAGGAGGA | SEQ ID NO: 2874 |
| RNF11 | NM_014372.3 | ACCCTGGAAGAGATGGATCAGAAAAAAGATCCGGGAGTGTGTGATCTGTATGATGGACTTTGTTTATGGGGACCCAAT | SEQ ID NO: 2875 |
| ROCK1 | NM_005406.1 | TGTGCACATAGGAATGAGCTTCAGATGCAGTTGGCCAGCAAAGAGAGTGATATTGAGCAATTGCGTGCTAAAC | SEQ ID NO: 2876 |
| ROCK2 | NM_004850.3 | GATCCGAGACCCTCGCTCCCCCATCAACGTGGAGAGCTTGCTGGATGGCTTAAATTCCTTGGTCCT | SEQ ID NO: 2877 |
| RPLPO | NM_001002.2 | CCATTCTATCATCAACGGGTACAAACGAGTCCTGGCCTTGTCTGTGGAGACGGATTACACCTTCCCACTTGCTGA | SEQ ID NO: 2878 |
| RPS13 | NM_001017.2 | CAGTCGGCTTTACCCTATCGACGCAGCGTCCCCACTTGGTTGAAGTTGACATCTGACGACGTGAAGGAGCAGA | SEQ ID NO: 2879 |
| RRM1 | NM_001033.1 | GGGCTACTGGCAGCTACATTGCTGGGACTAATGGCAATTCCAATGGCCTTGTACCGATGCTGAGAG | SEQ ID NO: 2880 |

TABLE B-continued

| Gene | Locus Link | Sequence | SEQ ID NO |
|---|---|---|---|
| RRM2 | NM_001034.1 | CAGCGGGATTAAACAGTCCTTTAACCAGCACAGCCAGTTAAAAGATGCAGCCTCACTGCTTC AACGCAGAT | SEQ ID NO: 2881 |
| RTN4 | NM_007008.1 | GACTGGAGTGGTGTTTGGTGCCAGCCTATTCCTGCTGCTTTCATTGACAGTATTCAGCATTGT GAGCGTAACAG | SEQ ID NO: 2882 |
| RUNX1 | NM_001754.2 | AACAGAGACATTGCCAACCATATTGGATCTGCTTGCTGTCCAAACCAGCAAACTTCCTGGGC AAATCAC | SEQ ID NO: 2883 |
| RXRA | NM_002957.3 | GCTCTGTTGTGTCCTGTTGCCGGCTCTGGCCTTCCTGTGACTGACTGTGAAGTGGCTTCTCCG TAC | SEQ ID NO: 2884 |
| S100A1 | NM_006271.1 | TGGACAAGGTGATGAAGGAGCTAGACGAGAATGGAGACGGGGAGGTGGACTTCCAGGAGT ATGTGGTGCT | SEQ ID NO: 2885 |
| S100A2 | NM_005978.2 | TGGCTGTGCTGGTCACTACCTTCCACAAGTACTCCTGCCAAGAGGGCGACAAGTTCAAGCTG AGTAAGGGGGA | SEQ ID NO: 2886 |
| S100A4 | NM_002961.2 | GACTGCTGTCATGGCGTGCCCTCTGGAGAAGGCCCTGGATGTGATGGTGTCCACCTTCCACA AGTACTCG | SEQ ID NO: 2887 |
| S100A8 | NM_002964.3 | ACTCCCTGATAAAGGGGAATTTCCATGCCGTCTACAGGGATGACCTGAAGAAATTGCTAGA GACCGAGTGTCCTCA | SEQ ID NO: 2888 |
| S100A9 | NM_002965.2 | CTTTGGGACAGAGTGCAAGACGATGACTTGCAAAATGTCGCAGCTGGAACGCAACATAGAG ACCA | SEQ ID NO: 2889 |
| S100P | NM_005980.2 | AGACAAGGATGCCGTGGATAAATTGCTCAAGGACCTGGACGCCAATGGAGATGCCCAGGTG GACTTC | SEQ ID NO: 2890 |
| SAT | NM_002970.1 | CCTTTTACCACTGCCTGGTTGCAGAAGTGCCGAAAGAGCACTGGACTCCGGAAGGACACAG CATTGT | SEQ ID NO: 2891 |
| SBA2 | NM_018639.3 | GGACTCAACGATGGGCAGATCAAGATCTGGGAGGTGCAGACAGGGCTCCTGCTTTTGAATC TTTCCG | SEQ ID NO: 2892 |
| SDC1 | NM_002997.1 | GAAATTGACGAGGGGTGTCTTGGGCAGAGCTGGCTCTGAGCGCCTCCATCCAAGGCCAGGT TCTCCGTTAGCTCCT | SEQ ID NO: 2893 |
| SEMA3B | NM_004636.1 | GCTCCAGGATGTGTTTCTGTTGTCCTCGCGGGACCACCGGACCCCGCTGCTCTATGCCGTCTT CTCCACGT | SEQ ID NO: 2894 |
| SEMA3F | NM_004186.1 | CGCGAGCCCCTCATTATACACTGGGCAGCCTCCCCACAGCGCATCGAGGAATGCGTGCTCTC AGGCAAGGATGTCAACGGCGAGTG | SEQ ID NO: 2895 |
| SEMA4B | NM_020210.1 | TTCCAGCCCAACACAGTGAACACTTTGGCCTGCCCGCTCCTCTCCAACCTGGCGACCCGACTC | SEQ ID NO: 2896 |
| SFRP2 | NM_003013.2 | CAAGCTGAACGGTGTGTCCGAAAGGGACCTGAAGAAATCGGTGCTGTGGCTCAAAGACAGC TTGCA | SEQ ID NO: 2897 |
| SFRP4 | NM_003014.2 | TACAGGATGAGGCTGGGCATTGCCTGGGACAGCCTATGTAAGGCCATGTGCCCCTTGCCCTA ACAAC | SEQ ID NO: 2898 |
| SGCB | NM_000232.1 | CAGTGGAGACCAGTTGGGTAGTGGTGACTGGGTACGCTACAAGCTCTGCATGTGTGCTGATG GGACGCTCTTCAAGG | SEQ ID NO: 2899 |

TABLE B-continued

| Gene | Locus Link | Sequence | SEQ ID NO |
|---|---|---|---|
| SHC1 | NM_003029.3 | CCAACACCTTCTTGGCTTCTGGGACCTGTGTTCTTGCTGAGCACCCTCTCCGGTTTGGGTTGG GATAACAG | SEQ ID NO: 2900 |
| SHH | NM_000193.2 | GTCCAAGGCACATATCCACTGCTCGGTGAAAGCAGAGAACTCGGTGGCGGCCAAATCGGGA GGCTGCTTC | SEQ ID NO: 2901 |
| SI | NM_001041.1 | AACGGACTCCCTCAATTTGTGCAAGATTTGCATGACCATGGACAGAAATATGTCATCATCTT GGACCCTGCAATTTC | SEQ ID NO: 2902 |
| Siah-1 | NM_003031.2 | TTGGCATTGGAACTACATTCAATCCGCGGTATCCTCGGATTAGTTCTAGGACCCCCTTCTCCA TACC | SEQ ID NO: 2903 |
| SIAT4A | NM_003033.2 | AACCACAGTTGGAGGAGGACGGCAGAGACAGTTTCCCTCCCCGCTATACCAACACCCTTCCT TCG | SEQ ID NO: 2904 |
| SIAT7B | NM_006456.1 | TCCAGCCCAAATCCTCCTGGTGGCACATCCTACCCCAGATGCTAAAGTGATTCAAGGACTCC AGGACACC | SEQ ID NO: 2905 |
| SIM2 | NM_005069.2 | GATGGTAGGAAGGGATGTGCCCGCCTCTCCACGCACTCAGCTATACCTCATTCACAGCTCCT TGTG | SEQ ID NO: 2906 |
| SIN3A | NM_015477.1 | CCAGAGTCATGCTCATCCAGCCCCACCAGTTGCACCAGTGCAGGGACAGCAGCAATTTCAG AGGCTGAAGGTGG | SEQ ID NO: 2907 |
| SIR2 | NM_012238.3 | AGCTGGGGTGTCTGTTTCATGTGGAATACCTGACTTCAGGTCAAGGGATGGTATTTATGCTC GCCTTGCTGT | SEQ ID NO: 2908 |
| SKP1A | NM_006930.2 | CCATTGCCTTTGCTTTGTTCATAATTTCAGCAGGGCAGAATAAAAACCATGGGAGGCAAAGA AAGGAAATCCGGAA | SEQ ID NO: 2909 |
| SKP2 | NM_005983.2 | AGTTGCAGAATCTAAGCCTGGAAGGCCTGCGGCTTTCGGATCCCATTGTCAATACTCTCGCA AAAAACTCA | SEQ ID NO: 2910 |
| SLC25A3 | NM_213611.1 | TCTGCCAGTGCTGAATTCTTTGCTGACATTGCCCTGGCTCCTATGGAAGCTGCTAAGGTTCGAA | SEQ ID NO: 2911 |
| SLC2A1 | NM_006516.1 | GCCTGAGTCTCCTGTGCCCACATCCCAGGCTTCACCCTGAATGGTTCCATGCCTGAGGGTGG AGACT | SEQ ID NO: 2912 |
| SLC31A1 | NM_001859.2 | CCGTTCGAAGAGTCGTGAGGGGGTGACGGGTTAAGATTCGGAGAGAGAGGTGCTAGTGGCT GGACT | SEQ ID NO: 2913 |
| SLC5A8 | NM_145913.2 | CCTGCTTTCAACCACATTGAATTGAACTCAGATCAGAGTGGCAAGAGCAATGGGACTCGTTT GTGAAGCTGCTCT | SEQ ID NO: 2914 |
| SLC7A5 | NM_003486.4 | GCGCAGAGGCCAGTTAAAGTAGATCACCTCCTCGAACCCACTCCGGTTCCCCGCAACCCACA GCTCAGCT | SEQ ID NO: 2915 |
| SLPI | NM_003064.2 | ATGGCCAATGTTTGATGCTTAACCCCCCCAATTTCTGTGAGATGGATGGCCAGTGCAAGCGT GACTTGAAGTGT | SEQ ID NO: 2916 |
| SMARCA3 | NM_003071.2 | AGGGACTGTCCTGGCACATTATGCAGATGTCCTGGGTCTTTTGCTTAGACTGCGGCAAATTT GTTG | SEQ ID NO: 2917 |
| SNAI1 | NM_005985.2 | CCCAATCGGAAGCCTAACTACAGCGAGCTGCAGGACTCTAATCCAGAGTTTACCTTCCAGCA GCCCTAC | SEQ ID NO: 2918 |

TABLE B-continued

| Gene | Locus Link | Sequence | SEQ ID NO |
|---|---|---|---|
| SNAI2 | NM_003068.3 | GGCTGGCCAAACATAAGCAGCTGCACTGCGATGCCCAGTCTAGAAAATCTTTCAGCTGTAAA TACTGTGACAAGGA | SEQ ID NO: 2919 |
| SNRPF | NM_003095.1 | GGCTGGTCGGCAGAGAGTAGCCTGCAACATTCGGCCGTGGTTTACATGAGTTTACCCCTCAA TCCCAAACCTTTCCTCA | SEQ ID NO: 2920 |
| SOD1 | NM_000454.3 | TGAAGAGAGGCATGTTGGAGACTTGGGCAATGTGACTGCTGACAAAGATGGTGTGGCCGAT GTGTCTATT | SEQ ID NO: 2921 |
| SOD2 | NM_000636.1 | GCTTGTCCAAATCAGGATCCACTGCAAGGAACAACAGGCCTTATTCCACTGCTGGGGATTGA TGTGTGGGAGCACGCT | SEQ ID NO: 2922 |
| SOS1 | NM_005633.2 | TCTGCACCAAATTCTCCAAGAACACCGTTAACACCTCCGCCTGCTTCTGGTGCTTCCAGTACC AC | SEQ ID NO: 2923 |
| SOX17 | NM_022454.2 | TCGTGTGCAAGCCTGAGATGGGCCTCCCCTACCAGGGGCATGACTCCGGTGTGAATCTCCCC GACAG | SEQ ID NO: 2924 |
| SPARC | NM_003118.1 | TCTTCCCTGTACACTGGCAGTTCGGCCAGCTGGACCAGCACCCCATTGACGGGTACCTCTCC CACACCGAGCT | SEQ ID NO: 2925 |
| SPINT2 | NM_021102.1 | AGGAATGCAGCGGATTCCTCTGTCCCAAGTGCTCCCAGAAGGCAGGATTCTGAAGACCACTC CAGCGA | SEQ ID NO: 2926 |
| SPRY1 | AK026960.1 | CAGACCAGTCCCTGGTCATAGGTCTGAAAGGGCAATCCGGACCCAGCCCAAGCAACTGATT GTGGATGACTTGAAGG | SEQ ID NO: 2927 |
| SPRY2 | NM_005842.1 | TGTGGCAAGTGCAAATGTAAGGAGTGCACCTACCCAAGGCCTCTGCCATCAGACTGGATCTG CGAC | SEQ ID NO: 2928 |
| SR-A1 | NM_021228.1 | AGATGGAAGAAGCCAACCTGGCGAGCCGAGCGAAGGCCCAGGAGCTGATCCAGGCCACCA ACCAGATCCTCAGCCACAG | SEQ ID NO: 2929 |
| ST14 | NM_021978.2 | TGACTGCACATGGAACATTGAGGTGCCCAACAACCAGCATGTGAAGGTGCGCTTCAAATTCTT | SEQ ID NO: 2930 |
| STAT1 | NM_007315.1 | GGGCTCAGCTTTCAGAAGTGCTGAGTTGGCAGTTTTCTTCTGTCACCAAAAGAGGTCTCAAT GTGGACCAGCTGAACATGT | SEQ ID NO: 2931 |
| STAT3 | NM_003150.1 | TCACATGCCACTTTGGTGTTTCATAATCTCCTGGGAGAGATTGACCAGCAGTATAGCCGCTT CCTGCAAG | SEQ ID NO: 2932 |
| STAT5A | NM_003152.1 | GAGGCGCTCAACATGAAATTCAAGGCCGAAGTGCAGAGCAACCGGGGCCTGACCAAGGAG AACCTCGTGTTCCTGGC | SEQ ID NO: 2933 |
| STAT5B | NM_012448.1 | CCAGTGGTGGTGATCGTTCATGGCAGCCAGGACAACAATGCGACGGCCACTGTTCTCTGGGA CAATGCTTTTGC | SEQ ID NO: 2934 |
| STC1 | NM_003155.1 | CTCCGAGGTGAGGAGGACTCTCCCTCCCACATCAAACGCACATCCCATGAGAGTGCATAACC AGGGAGAGGT | SEQ ID NO: 2935 |
| STK11 | NM_000455.3 | GGACTCGGAGACGCTGTGCAGGAGGGCCGTCAAGATCCTCAAGAAGAAGAAGTTGCGAAG GATCCC | SEQ ID NO: 2936 |
| STK15 | NM_003600.1 | CATCTTCCAGGAGGACCACTCTCTGTGGCACCCTGGACTACCTGCCCCCTGAAATGATTGAA GGTCGGA | SEQ ID NO: 2937 |

TABLE B-continued

| Gene | Locus Link | Sequence | SEQ ID NO |
|---|---|---|---|
| STMN1 | NM_005563.2 | AATCCCAACGCACAAATGACCGCACGTTCTCTGCCCCGTTTCTTGCCCCAGTGTGGTTTGCATTGTCTCC | SEQ ID NO: 2938 |
| STMY3 | NM_005940.2 | CCTGGAGGCTGCAACATACCTCAATCCTGTCCCAGGCCGGATCCTCCTGAAGCCCTTTTCGCAGCACTGCTATCCTCCAAAGCCATTGTA | SEQ ID NO: 2939 |
| STS | NM_000351.2 | GAAGATCCCTTTCCTCCTACTGTTCTTTCTGTGGGAAGCCGAGAGCCACGAAGCATCAAGGCCGAACATCATCC | SEQ ID NO: 2940 |
| SURV | NM_001168.1 | TGTTTTGATTCCCGGGCTTACCAGGTGAGAAGTGAGGGAGGAAGAAGGCAGTGTCCCTTTTGCTAGAGCTGACAGCTTTG | SEQ ID NO: 2941 |
| TAGLN | NM_003186.2 | GATGGAGCAGGTGGCTCAGTTCCTGAAGGCGGCTGAGGACTCTGGGGTCATCAAGACTGACATGTTCCAGACT | SEQ ID NO: 2942 |
| TBP | NM_003194.1 | GCCCGAAACGCCGAATATAATCCCAAGCGGTTTGCTGCGGTAATCATGAGGATAAGAGAGCCACG | SEQ ID NO: 2943 |
| TCF-1 | NM_000545.3 | GAGGTCCTGAGCACTGCCAGGAGGGACAAAGGAGCCTGTGAACCCAGGACAAGCATGGTCCCACATC | SEQ ID NO: 2944 |
| TCF-7 | NM_003202.2 | GCAGCTGCAGTCAACAGTTCAAAGAAGTCATGGCCCAAATCCAGTGTGCACCCCTCCCCATTCACAG | SEQ ID NO: 2945 |
| TCF7L1 | NM_031283.1 | CCGGGACACTTTCCAGAAGCCGCGGGACTATTTCGCCGAAGTGAGAAGGCCTCAGGACAGCGCGTTCT | SEQ ID NO: 2946 |
| TCF7L2 | NM_030756.1 | CCAATCACGACAGGAGGATTCAGACACCCCTACCCCACAGCTCTGACCGTCAATGCTTCCGTGTCCA | SEQ ID NO: 2947 |
| TCFL4 | NM_170607.2 | CTGACTGCTCTGCTTAAAGGTGAAAGTAGCAGGAACAACAACAAAAGCCAACCAAAAACAAGGTAGCCAGTGCAAGACAT | SEQ ID NO: 2948 |
| TEK | NM_000459.1 | ACTTCGGTGCTACTTAACAACTTACATCCCAGGGAGCAGTACGTGGTCCGAGCTAGAGTCAACACCAAGGCCCAGG | SEQ ID NO: 2949 |
| TERC | U86046.1 | AAGAGGAACGGAGCGAGTCCCCGCGCGCGGCGCGATTCCCTGAGCTGTGGGACGTGCACCCAGGACTCGGCTCACACAT | SEQ ID NO: 2950 |
| TERT | NM_003219.1 | GACATGGAGAACAAGCTGTTTGCGGGGATTCGGCGGGACGGGCTGCTCCTGCGTTTGGTGGATGATTTCTTGTTGGTGACACCTC | SEQ ID NO: 2951 |
| TFF3 | NM_003226.1 | AGGCACTGTTCATCTCAGTTTTTCTGTCCCTTTGCTCCCGGCAAGCTTTCTGCTGAAAGTTCATATCTGGAGCCTGATG | SEQ ID NO: 2952 |
| TGFA | NM_003236.1 | GGTGTGCCACAGACCTTCCTACTTGGCCTGTAATCACCTGTGCAGCCTTTTGTGGGCCTTCAAAACTCTGTCAAGAACTCCGT | SEQ ID NO: 2953 |
| TGFB2 | NM_003238.1 | ACCAGTCCCCCAGAAGACTATCCTGAGCCCGAGGAAGTCCCCCCGGAGGTGATTTCCATCTACAACAGCACCAGG | SEQ ID NO: 2954 |
| TGFB3 | NM_003239.1 | GGATCGAGCTCTTCCAGATCCTTCGGCCAGATGAGCACATTGCCAAACAGCGCTATATCGGTGGC | SEQ ID NO: 2955 |
| TGFBI | NM_000358.1 | GCTACGAGTGCTGTCCTGGATATGAAAAGGTCCCTGGGGAGAAGGGCTGTCCAGCAGCCCTACCACT | SEQ ID NO: 2956 |

TABLE B-continued

| Gene | Locus Link | Sequence | SEQ ID NO |
|---|---|---|---|
| TGFBR1 | NM_004612.1 | GTCATCACCTGGCCTTGGTCCTGTGGAACTGGCAGCTGTCATTGCTGGACCAGTGTGCTTCGT CTGC | SEQ ID NO: 2957 |
| TGFBR2 | NM_003242.2 | AACACCAATGGGTTCCATCTTTCTGGGCTCCTGATTGCTCAAGCACAGTTTGGCCTGATGAA GAGG | SEQ ID NO: 2958 |
| THBS1 | NM_003246.1 | CATCCGCAAAGTGACTGAAGAGAACAAAGAGTTGGCCAATGAGCTGAGGCGGCCTCCCCTA TGCTATCACAACGGAGTTCAGTAC | SEQ ID NO: 2959 |
| THY1 | NM_006288.2 | GGACAAGACCCTCTCAGGCTGTCCCAAGCTCCCAAGAGCTTCCAGAGCTCTGACCCACAGCC TCCAA | SEQ ID NO: 2960 |
| TIMP1 | NM_003254.1 | TCCCTGCGGTCCCAGATAGCCTGAATCCTGCCCGGAGTGGAACTGAAGCCTGCACAGTGTCC ACCCTGTTCCCAC | SEQ ID NO: 2961 |
| TIMP2 | NM_003255.2 | TCACCCTCTGTGACTTCATCGTGCCCTGGGACACCCTGAGCACCACCCAGAAGAAGAGCCTG AACCACA | SEQ ID NO: 2962 |
| TIMP3 | NM_000362.2 | CTACCTGCCTTGCTTTGTGACTTCCAAGAACGAGTGTCTCTGGACCGACATGCTCTCCAATTT CGGT | SEQ ID NO: 2963 |
| TJP1 | NM_003257.1 | ACTTTGCTGGGACAAAGGTCAACTGAAGAAGTGGGCAGGCCCGAGGCAGGAGAGATGCTGA GGAGTCCATGTG | SEQ ID NO: 2964 |
| TK1 | NM_003258.1 | GCCGGGAAGACCGTAATTGTGGCTGCACTGGATGGGACCTTCCAGAGGAAGCCATTTGGGG CCATCCTGAACCTGGTGCCGCTG | SEQ ID NO: 2965 |
| TLN1 | NM_006289.2 | AAGCAGAAGGGAGAGCGTAAGATCTTCCAGGCACACAAGAATTGTGGGCAGATGAGTGAG ATTGAGGCCAAGG | SEQ ID NO: 2966 |
| TMEPAI | NM_020182.3 | CAGAAGGATGCCTGTGGCCCTCGGAGAGCACAGTGTCAGGCAACGGAATCCCAGAGCCGCA GGTCTAC | SEQ ID NO: 2967 |
| TMSB10 | NM_021103.2 | GAAATCGCCAGCTTCGATAAGGCCAAGCTGAAGAAAACGGAGACGCAGGAAAAGAACACC CTGCCGAC | SEQ ID NO: 2968 |
| TMSB4X | NM_021109.2 | CACATCAAAGAACTACTGACAACGAAGGCCGCGCCTGCCTTTCCCATCTGTCTATCTATCTG GCTGGCAGG | SEQ ID NO: 2969 |
| TNC | NM_002160.1 | AGCTCGGAACCTCACCGTGCCTGGCAGCCTTCGGGCTGTGGACATACCGGGCCTCAAGGCTG CTAC | SEQ ID NO: 2970 |
| TNF | NM_000594.1 | GGAGAAGGGTGACCGACTCAGCGCTGAGATCAATCGGCCCGACTATCTCGACTTTGCCGAG TCTGGGCA | SEQ ID NO: 2971 |
| TNFRSF5 | NM_001250.3 | TCTCACCTCGCTATGGTTCGTCTGCCTCTGCAGTGCGTCCTCTGGGGCTGCTTGCTGACCGCT GTCCATC | SEQ ID NO: 2972 |
| TNFRSF6B | NM_003823.2 | CCTCAGCACCAGGGTACCAGGAGCTGAGGAGTGTGAGCGTGCCGTCATCGACTTTGTGGCTT TCCAGGACA | SEQ ID NO: 2973 |
| TNFSF4 | NM_003326.2 | CTTCATCTTCCCTCTACCCAGATTGTGAAGATGGAAAGGGTCCAACCCCTGGAAGAGAATGT GGGAAATGCAGC | SEQ ID NO: 2974 |
| TOP2A | NM_001067.1 | AATCCAAGGGGGAGAGTGATGACTTCCATATGGACTTTGACTCAGCTGTGGCTCCTCGGGCA AAATCTGTAC | SEQ ID NO: 2975 |

TABLE B-continued

| Gene | Locus Link | Sequence | SEQ ID NO |
|---|---|---|---|
| TOP2B | NM_001068.1 | TGTGGACATCTTCCCCTCAGACTTCCCTACTGAGCCACCTTCTCTGCCACGAACCGGTCGGGCTAG | SEQ ID NO: 2976 |
| TP | NM_001953.2 | CTATATGCAGCCAGAGATGTGACAGCCACCGTGGACAGCCTGCCACTCATCACAGCCTCCATTCTCAGTAAGAAACTCGTGG | SEQ ID NO: 2977 |
| TP53BP1 | NM_005657.1 | TGCTGTTGCTGAGTCTGTTGCCAGTCCCCAGAAGACCATGTCTGTGTTGAGCTGTATCTGTGAAGCCAGGCAAG | SEQ ID NO: 2978 |
| TP53BP2 | NM_005426.1 | GGGCCAAATATTCAGAAGCTTTTATATCAGAGGACCACCATAGCGGCCATGGAGACCATCTCTGTCCCATCATACCCATCC | SEQ ID NO: 2979 |
| TP53I3 | NM_004881.2 | GCGGACTTAATGCAGAGACAAGGCCAGTATGACCCACCTCCAGGAGCCAGCAACATTTTGGGACTTGA | SEQ ID NO: 2980 |
| TRAG3 | NM_004909.1 | GACGCTGGTCTGGTGAAGATGTCCAGGAAACCACGAGCCTCCAGCCCATTGTCCAACAACCACCCA | SEQ ID NO: 2981 |
| TRAIL | NM_003810.1 | CTTCACAGTGCTCCTGCAGTCTCTCTGTGTGGCTGTAACTTACGTGTACTTTACCAACGAGCTGAAGCAGATG | SEQ ID NO: 2982 |
| TS | NM_001071.1 | GCCTCGGTGTGCCTTTCAACATCGCCAGCTACGCCCTGCTCACGTACATGATTGCGCACATCACG | SEQ ID NO: 2983 |
| TST | NM_003312.4 | GGAGCCGGATGCAGTAGGACTGGACTCGGGCCATATCCGTGGTGCCGTCAACATGCCTTTCATGGACTT | SEQ ID NO: 2984 |
| TUBA1 | NM_006000.1 | TGTCACCCCGACTCAACGTGAGACGCACCGCCCGGACTCACCATGCGTGAATGCATCTCAGTCCACGT | SEQ ID NO: 2985 |
| TUBB | NM_001069.1 | CGAGGACGAGGCTTAAAAACTTCTCAGATCAATCGTGCATCCTTAGTGAACTTCTGTTGTCCTCAAGCATGGT | SEQ ID NO: 2986 |
| TUFM | NM_003321.3 | GTATCACCATCAATGCGGCTCATGTGGAGTATAGCACTGCCGCCCGCCACTACGCCCACACAGACTG | SEQ ID NO: 2987 |
| TULP3 | NM_003324.2 | TGTGTATAGTCCTGCCCCTCAAGGTGTCACAGTAAGATGTCGGATAATCCGGGATAAAAGGGGAATGGATCGGG | SEQ ID NO: 2988 |
| tusc4 | NM_006545.4 | GGAGGAGCTAAATGCCTCAGGCCGGTGCACTCTGCCCATTGATGAGTCCAACACCATCCACTTGAAGG | SEQ ID NO: 2989 |
| UBB | NM_018955.1 | GAGTCGACCCTGCACCTGGTCCTGCGTCTGAGAGGTGGTATGCAGATCTTCGTGAAGACCCTGACCGGCAAGACCATCACCCTGGAAGTGGAGCCCAGTGACACCATCGAAAATGTGAAGGCCAAGATCCAGGATAAAGAAGGCATCCCTCCCGACCAGCAGAGGCTCATCTTTGCAGGCAAGCAGCTGGAAGATGGCCGCACTCTTTCTGACTACAACATCCAGAAGGAGTCGACCCTGCACCTGGTCCTGCGTCTGAGAGGTGGTATGCAGATCTTCGTGAAGACCCTGACCGGCAAGACCATCACTCTGGAAGTGGAGCCCAGTGACACCATCGAAAATGTGAAGGCCAAGATCCAAGATAAAGAAGGCATCCCTCCCGACCAGCAGAGGCTCATCTTTGCAGGCAAGCAGCTGGAAGATGGCCGCACTCTTTCTGACTACAACATCCAGAAGGAGTCGACCCTGCACCTGGTCCTGCGCCTGAGGGGTGGCTGTTAATTCTTCAGTCATGGCATTCGC | SEQ ID NO: 2990 |
| UBC | NM_021009.2 | ACGCACCCTGTCTGACTACAACATCCAGAAAGAGTCCACCCTGCACCTGGTGCTCCGTCTTAGAGGT | SEQ ID NO: 2991 |
| UBE2C | NM_007019.2 | TGTCTGGCGATAAAGGGATTCTGCCTTCCCTGAATCAGACAACCTTTTCAAATGGGTAGGGACCAT | SEQ ID NO: 2992 |

TABLE B-continued

| Gene | Locus Link | Sequence | SEQ ID NO |
|---|---|---|---|
| UBE2M | NM_003969.1 | CTCCATAATTTATGGCCTGCAGTATCTCTTCTTGGAGCCCAACCCCGAGGACCCACTGAACAAGGAGGCCGCA | SEQ ID NO: 2993 |
| UBL1 | NM_003352.3 | GTGAAGCCACCGTCATCATGTCTGACCAGGAGGCAAAACCTTCAACTGAGGACTTGGGGGATAAGAAGGAAGG | SEQ ID NO: 2994 |
| UCP2 | NM_003355.2 | ACCATGCTCCAGAAGGAGGGGCCCCGAGCCTTCTACAAAGGGTTCATGCCCTCCTTTCTCCGCTTGGGTT | SEQ ID NO: 2995 |
| UGT1A1 | NM_000463.2 | CCATGCAGCCTGGAATTTGAGGCTACCCAGTGCCCCAACCCATTCTCCTACGTGCCCAGGCCTCTC | SEQ ID NO: 2996 |
| UMPS | NM_000373.1 | TGCGGAAATGAGCTCCACCGGCTCCCTGGCCACTGGGGACTACACTAGAGCAGCGGTTAGAATGGCTGAGG | SEQ ID NO: 2997 |
| UNC5A | XM_030300.7 | GACAGCTGATCCAGGAGCCACGGGTCCTGCACTTCAAGGACAGTTACCACAACCTGCGCCTATCCAT | SEQ ID NO: 2998 |
| UNC5B | NM_170744.2 | AGAACGGAGGCCGTGACTGCAGCGGGACGCTGCTCGACTCTAAGAACTGCACAGATGGGCTGTGCATG | SEQ ID NO: 2999 |
| UNC5C | NM_003728.2 | CTGAACACAGTGGAGCTGGTTTGCAAACTCTGTGTGCGGCAGGTGGAAGGAGAAGGGCAGATCTTCCAG | SEQ ID NO: 3000 |
| upa | NM_002658.1 | GTGGATGTGCCCTGAAGGACAAGCCAGGCGTCTACACGAGAGTCTCACACTTCTTACCCTGGATCCGCAG | SEQ ID NO: 3001 |
| UPP1 | NM_003364.2 | ACGGGTCCTGCCTCAGTTGGCGGAATGGCGGCCACGGGAGCCAATGCAGAGAAAGCTGAAAGTCACAATGATTGCCCCG | SEQ ID NO: 3002 |
| VCAM1 | NM_001078.2 | TGGCTTCAGGAGCTGAATACCCTCCCAGGCACACACAGGTGGGACACAAATAAGGGTTTTGGAACCACTATTTTCTCATCACGACAGCA | SEQ ID NO: 3003 |
| VCL | NM_003373.2 | GATACCACAACTCCCATCAAGCTGTTGGCAGTGGCAGCCACGGCGCCTCCTGATGCGCCTAACAGGGA | SEQ ID NO: 3004 |
| VCP | NM_007126.2 | GGCTTTGGCAGCTTCAGATTCCCTTCAGGGAACCAGGGTGGAGCTGGCCCCAGTCAGGGCAGTGGAG | SEQ ID NO: 3005 |
| VDAC1 | NM_003374.1 | GCTGCGACATGGATTTCGACATTGCTGGGCCTTCCATCCGGGGTGCTCTGGTGCTAGGTTACGAGGGCTGG | SEQ ID NO: 3006 |
| VDAC2 | NM_003375.2 | ACCCACGGACAGACTTGCGCGCGTCCAATGTGTATTCCTCCATCATATGCTGACCTTGGCAAAGCT | SEQ ID NO: 3007 |
| VDR | NM_000376.1 | GCCCTGGATTTCAGAAAGAGCCAAGTCTGGATCTGGGACCCTTTCCTTCCTTCCCTGGCTTGTAACT | SEQ ID NO: 3008 |
| VEGF | NM_003376.3 | CTGCTGTCTTGGGTGCATTGGAGCCTTGCCTTGCTGCTCTACCTCCACCATGCCAAGTGGTCCCAGGCTGC | SEQ ID NO: 3009 |
| VEGF_altsplice1 | AF486837.1 | TGTGAATGCAGACCAAAGAAAGATAGAGCAAGACAAGAAAATCCCTGTGGGCCTTGCTCAGAGCGGAGAAAGC | SEQ ID NO: 3010 |
| VEGF_altsplice2 | AF214570.1 | AGCTTCCTACAGCACAACAAATGTGAATGCAGACCAAAGAAAGATAGAGCAAGACAAGAAAAATGTGACAAGCCGAG | SEQ ID NO: 3011 |
| VEGFB | NM_003377.2 | TGACGATGGCCTGGAGTGTGTGCCCACTGGGCAGCACCAAGTCCGGATGCAGATCCTCATGATCCGGTACC | SEQ ID NO: |

TABLE B-continued

| Gene | Locus Link | Sequence | SEQ ID NO |
|---|---|---|---|
| | | | 3012 |
| VEGFC | NM_005429.2 | CCTCAGCAAGACGTTATTTGAAATTACAGTGCCTCTCTCTCAAGGCCCCAAACCAGTAACAATCAGTTTTGCCAATCACACTT | SEQ ID NO: 3013 |
| VIM | NM_003380.1 | TGCCCTTAAAGGAACCAATGAGTCCCTGGAACGCCAGATGCGTGAAATGGAAGAGAACTTTGCCGTTGAAGC | SEQ ID NO: 3014 |
| WIF | NM_007191.2 | TACAAGCTGAGTGCCCAGGCGGGTGCCGAAATGGAGGCTTTTGTAATGAAAGACGCATCTGCGAGTG | SEQ ID NO: 3015 |
| WISP1 | NM_003882.2 | AGAGGCATCCATGAACTTCACACTTGCGGGCTGCATCAGCACACGCTCCTATCAACCCAAGTACTGTGGAGTTTG | SEQ ID NO: 3016 |
| Wnt-3a | NM_033131.2 | ACAAAGCTACCAGGGAGTCGGCCTTTGTCCACGCCATTGCCTCAGCCGGTGTGGCCTTTGCAGTGACACGCTCA | SEQ ID NO: 3017 |
| Wnt-5a | NM_003392.2 | GTATCAGGACCACATGCAGTACATCGGAGAAGGCGCGAAGACAGGCATCAAAGAATGCCAGTATCAATTCCGACA | SEQ ID NO: 3018 |
| Wnt-5b | NM_032642.2 | TGTCTTCAGGGTCTTGTCCAGAATGTAGATGGGTTCCGTAAGAGGCCTGGTGCTCTCTTACTCTTTCATCCACGTGCAC | SEQ ID NO: 3019 |
| WNT2 | NM_003391.1 | CGGTGGAATCTGGCTCTGGCTCCCTCTGCTCTTGACCTGGCTCACCCCCGAGGTCAACTCTTCATGG | SEQ ID NO: 3020 |
| WWOX | NM_016373.1 | ATCGCAGCTGGTGGGTGTACACACTGCTGTTTACCTTGGCGAGGCCTTTCACCAAGTCCATGCAACAGGGAGCT | SEQ ID NO: 3021 |
| XPA | NM_000380.2 | GGGTAGAGGGAAAAGGGTTCAACAAAGGCTGAACTGGATTCTTAACCAAGAAACAAATAATAGCAATGGTGGTGCA | SEQ ID NO: 3022 |
| XPC | NM_004628.2 | GATACATCGTCTGCGAGGAATTCAAAGACGTGCTCCTGACTGCCTGGGAAAATGAGCAGGCAGTCATTGAAAG | SEQ ID NO: 3023 |
| XRCC1 | NM_006297.1 | GGAGATGAAGCCCCCAAGCTTCCTCAGAAGCAACCCCAGACCAAAACCAAGCCCACTCAGGCAGCTGGAC | SEQ ID NO: 3024 |
| YB-1 | NM_004559.1 | AGACTGTGGAGTTTGATGTTGTTGAAGGAGAAAAGGGTGCGGAGGCAGCAAATGTTACAGGTCCTGGTGGTGTTCC | SEQ ID NO: 3025 |
| YWHAH | NM_003405.2 | CATGGCCTCCGCTATGAAGGCGGTGACAGAGCTGAATGAACCTCTCTCCAATGAAGATCGAAATCTCC | SEQ ID NO: 3026 |
| zbtb7 | NM_015898.2 | CTGCGTTCACACCCCAGTGTCACAGGGCGAGCTGTTCTGGAGAGAAAACCATCTGTCGTGGCTGAG | SEQ ID NO: 3027 |
| ZG16 | NM_152338.1 | TGCTGAGCCTCCTCTCCTTGGCAGGGCACTGTGATGAGGAGTAAGAACTCCCTTATCACTAACCCCCATCC | SEQ ID NO: 3028 |

TABLE 4

| Variable | Most Highly Correlated Genes | | | | | | | | | |
|---|---|---|---|---|---|---|---|---|---|---|
| | Rank 1 | Rank 2 | Rank 3 | Rank 4 | Rank 5 | Rank 6 | Rank 7 | Rank 8 | Rank 9 | Rank 10 |
| ADAMTS12 | SPARC 0.7317 | TIMP2 0.7177 | COL1A1 0.7077 | ANTXR1 0.7022 | BGN 0.6962 | LOXL2 0.6679 | THY1 0.6665 | CDH11 0.647 | IGFBP7 0.6433 | COL1A2 0.6393 |
| ANTXR1 | TIMP2 0.8358 | BGN 0.8159 | COL1A1 0.7796 | THY1 0.7696 | FAP 0.7261 | SFRP4 0.7154 | SPARC 0.7138 | TGFB3 0.7119 | ADAMTS12 0.7022 | PDGFC 0.6992 |
| BGN | COL1A1 0.8986 | SPARC 0.8711 | TIMP2 0.8446 | FAP 0.8177 | ANTXR1 0.8159 | TGFB3 0.8147 | SFRP2 0.7854 | INHBA 0.7854 | WISP1 0.7682 | CTHRC1 0.7668 |
| CALD1 | IGFBP5 0.7483 | TAGLN 0.7452 | CDH11 0.7339 | TIMP2 0.691 | MYLK 0.6846 | PDGFC 0.6822 | DLC1 0.6707 | ANTXR1 0.6524 | IGFBP7 0.6494 | SPARC 0.649 |
| CDH11 | SPARC 0.7831 | TIMP2 0.7629 | IGFBP7 0.7587 | CALD1 0.7339 | TAGLN 0.7338 | IGFBP5 0.7319 | COL1A2 0.7272 | BGN 0.7265 | MMP2 0.7019 | PDGFC 0.6845 |
| COL1A1 | BGN 0.8986 | SPARC 0.8713 | TIMP2 0.8071 | FAP 0.7833 | ANTXR1 0.7796 | LOXL2 0.7338 | COL1A2 0.7319 | CTHRC1 0.7496 | TGFB3 0.7491 | WISP1 0.7442 |
| COL1A2 | SPARC 0.8549 | MMP2 0.7886 | COL1A1 0.7642 | THBS1 0.7409 | BGN 0.7368 | CDH11 0.7272 | LOXL2 0.7248 | ITGA5 0.7243 | CTHRC1 0.7112 | INHBA 0.7005 |
| CTGF | CYR61 0.8028 | THBS1 0.7694 | INHBA 0.7078 | BGN 0.6912 | COL1A2 0.6893 | SPARC 0.6886 | PAI1 0.6763 | VIM 0.6747 | SFRP2 0.6688 | CXCL12 0.6683 |
| CTHRC1 | FAP 0.7713 | BGN 0.7668 | COL1A1 0.7496 | INHBA 0.7348 | COL1A2 0.7112 | TIMP3 0.7078 | SFRP2 0.699 | SPARC 0.6964 | TIMP2 0.6853 | LOXL2 0.6683 |
| CTSL | TP 0.6975 | SOD2 0.6913 | ITGA5 0.6748 | UPA 0.6448 | TIMP1 0.6448 | THBS1 0.636 | PAI1 0.6296 | COL1A2 0.6152 | DPYD 0.6151 | CD68 0.6148 |
| CXCL12 | BGN 0.6838 | CTGF 0.6683 | SFRP2 0.6649 | TIMP2 0.6558 | TGFB3 0.6254 | VIM 0.6212 | COL1A1 0.6206 | SPARC 0.6173 | CYR61 0.6149 | MCP1 0.6022 |
| CYR61 | CTGF 0.8028 | DUSP1 0.7338 | THBS1 0.6623 | PAI1 0.6334 | COL1A2 0.6272 | INHBA 0.6257 | CXCL12 0.6149 | CTHRC1 0.5918 | VIM 0.576 | GADD45B 0.573 |
| DLC1 | TIMP2 0.6783 | CALD1 0.6707 | IGFBP5 0.653 | TGFB3 0.6465 | BGN 0.6399 | ANTXR1 0.6378 | TAGLN 0.6075 | THY1 0.6065 | HSPG2 0.6047 | TLN1 0.5982 |
| DUSP1 | CYR61 0.7338 | FOS 0.7183 | CTGF 0.6632 | PAI1 0.6545 | EGR1 0.6357 | NR4A1 0.5993 | GADD45B 0.5877 | THBS1 0.5827 | CXCL12 0.5262 | EGR3 0.5184 |
| FAP | BGN 0.8177 | COL1A1 0.7833 | CTHRC1 0.7348 | TIMP2 0.7364 | INHBA 0.7286 | ANTXR1 0.7261 | SFRP2 0.7189 | WISP1 0.7147 | TIMP3 0.7027 | TGFB3 0.7001 |
| HSPG2 | TIMP2 0.7455 | THY1 0.7425 | IGFBP7 0.7246 | SPARC 0.6959 | TAGLN 0.6857 | ANTXR1 0.6678 | BGN 0.6625 | IGFBP5 0.6259 | COL1A1 0.608 | CDH11 0.6052 |
| IGFBP5 | TAGLN 0.7829 | IGFBP7 0.764 | CALD1 0.7483 | CDH11 0.7319 | TIMP2 0.6893 | SPARC 0.6781 | MYLK 0.6532 | DLC1 0.653 | TIMP1 0.6403 | BGN 0.6374 |
| IGFBP7 | TAGLN 0.8225 | SPARC 0.7715 | IGFBP5 0.764 | CDH11 0.7587 | THY1 0.7428 | HSPG2 0.7246 | TIMP2 0.7139 | SFRP4 0.6558 | ANTXR1 0.6541 | PDGFC 0.6538 |
| INHBA | BGN 0.7854 | SPARC 0.774 | CTHRC1 0.7348 | FAP 0.7286 | COL1A1 0.7202 | CTGF 0.7078 | COL1A2 0.7005 | CDH11 0.6744 | THBS1 0.6685 | LOXL2 0.6613 |
| ITGA5 | COL1A2 0.7243 | THBS1 0.7058 | MMP2 0.6969 | SPARC 0.6772 | CTSL 0.6748 | PAI1 0.671 | TIMP1 0.6374 | UPA 0.6357 | NRP2 0.6301 | SNAI2 0.623 |
| LOXL2 | COL1A1 0.7724 | SPARC 0.7606 | BGN 0.7415 | COL1A2 0.7248 | TIMP2 0.7174 | ANTXR1 0.6829 | CTHRC1 0.67 | ADAMTS12 0.6679 | INHBA 0.6613 | FAP 0.6439 |
| LOX | SPARC 0.7433 | COL1A1 0.7065 | BGN 0.695 | COL1A2 0.62 | INHBA 0.604 | LOXL2 0.5981 | PDGFRA 0.5865 | THY1 0.5672 | GJB2 0.5664 | SFRP2 0.5599 |
| MMP2 | COL1A2 0.7886 | SPARC 0.7229 | THBS1 0.7172 | COL1A2 0.7019 | ITGA5 0.6969 | TAGLN 0.6663 | PDGFRA 0.6662 | VIM 0.6556 | CALD1 0.6356 | NRP2 0.6188 |
| MYLK | TAGLN | MYH11 | CALD1 | IGFBP7 | IGFBP5 | CDH11 | TLN1 | CRYAB | | PDGFRA |

TABLE 4-continued

Most Highly Correlated Genes

| Variable | Rank 1 | Rank 2 | Rank 3 | Rank 4 | Rank 5 | Rank 6 | Rank 7 | Rank 8 | Rank 9 | Rank 10 |
|---|---|---|---|---|---|---|---|---|---|---|
| NRP2 | 0.7671 | 0.7329 | 0.6846 | 0.6532 | 0.6456 | 0.6347 | 0.6335 | 0.6075 | 0.6057 | 0.5934 |
|  | TAGLN | SPARC | TIMP2 | BGN | THBS1 | CDH11 | COL1A2 | VIM | PDGFC | CALD1 |
| PAI1 | 0.6954 | 0.6845 | 0.668 | 0.6663 | 0.6638 | 0.6615 | 0.6601 | 0.6532 | 0.6436 | 0.6417 |
|  | THBS1 | CTGF | ITGA5 | DUSP1 | CYR61 | CTSL | INHBA | SPARC | TIMP1 | COL1A2 |
| PDGFC | 0.6802 | 0.6763 | 0.671 | 0.6545 | 0.6477 | 0.6296 | 0.6138 | 0.6079 | 0.6019 | 0.59 |
|  | TIMP2 | ANTXR1 | ITGA5 | CDH11 | CALD1 | CTSL | COL1A2 | SPARC | TIMP1 | SFRP4 |
| SFRP2 | 0.707 | 0.6992 | 0.6961 | 0.6845 | 0.6822 | 0.6788 | 0.6684 | 0.654 | 0.6538 | 0.6487 |
|  | BGN | TGFB3 | COL1A1 | FAP | SPARC | BGN | CTGF | TAGLN | IGFBP7 | COL1A2 |
| SFRP4 | 0.811 | 0.7782 | 0.7263 | 0.7189 | 0.6994 | 0.699 | 0.6864 | 0.6688 | 0.6649 | 0.6536 |
|  | ANTXR1 | TGFB3 | COL1A1 | FAP | SPARC | CTHRC1 | TIMP2 | CTGF | CXCL12 | COL1A2 |
| SPARC | 0.7154 | 0.6734 | 0.6702 | 0.6662 | 0.6558 | 0.6487 | 0.6684 | 0.6291 | 0.6256 | 0.6103 |
|  | COL1A1 | CDH11 | COL1A2 | BGN | IGFBP7 | PDGFC | SFRP2 | SPARC | FAP | CTHRC1 |
| TAGLN | 0.8713 | 0.8711 | 0.8549 | 0.7967 | 0.7831 | 0.774 | 0.7715 | 0.7667 | 0.7606 | 0.7512 |
|  | IGFBP7 | BGN | MYLK | TIMP2 | CDH11 | INHBA | IGFBP7 | TAGLN | LOXL2 | THY1 |
| TGFB3 | 0.8225 | 0.7829 | 0.7671 | 0.7667 | 0.7452 | 0.7338 | 0.7004 | 0.6954 | 0.6857 | 0.6706 |
|  | IGFBP5 | SFRP2 | MYLK | SPARC | CALD1 | CDH11 | TIMP2 | NRP2 | HSPG2 | MYH11 |
| THBS1 | 0.8147 | 0.7782 | 0.7263 | 0.7331 | 0.7119 | 0.7095 | 0.7001 | 0.6652 | 0.6538 | 0.6465 |
|  | BGN | SFRP2 | COL1A1 | TIMP2 | ANTXR1 | SPARC | FAP | WISP1 | THY1 | DLC1 |
| THY1 | 0.7694 | 0.7409 | 0.7207 | 0.7172 | 0.7058 | 0.6802 | 0.6723 | 0.6685 | 0.6638 | 0.6635 |
|  | CTGF | COL1A2 | SPARC | MMP2 | ITGA5 | PAI1 | VIM | INHBA | NRP2 | CDH11 |
| TIMP1 | 0.7696 | 0.7782 | 0.7428 | 0.7425 | 0.7365 | 0.7327 | 0.7241 | 0.6665 | 0.6538 | 0.6334 |
|  | ANTXR1 | SPARC | IGFBP7 | HSPG2 | BGN | TIMP2 | COL1A1 | ADAMTS12 | TGFB3 | TAGLN |
| TIMP2 | 0.7068 | 0.7512 | 0.7428 | 0.7425 | 0.7365 | 0.7327 | 0.7241 | 0.6665 | 0.6538 | 0.6334 |
|  | SPARC | BGN | THBS1 | COL1A2 | CDH11 | CTSL | IGFBP5 | ITGA5 | NRP2 | NRP1 |
| TIMP3 | 0.7068 | 0.6713 | 0.6534 | 0.6518 | 0.6452 | 0.6448 | 0.6403 | 0.6374 | 0.6172 | 0.6172 |
|  | BGN | ANTXR1 | COL1A1 | SPARC | CDH11 | HSPG2 | FAP | ITGA5 | THY1 | WISP1 |
| TK1 | 0.8446 | 0.8358 | 0.8071 | 0.7967 | 0.7629 | 0.7455 | 0.7364 | 0.7331 | 0.7327 | 0.7263 |
|  | CTHRC1 | BGN | FAP | TIMP2 | ANTXR1 | INHBA | COL1A1 | TGFB3 | PDGFC | SFRP2 |
| TLN1 | 0.7078 | 0.7053 | 0.7027 | 0.6967 | 0.6644 | 0.6364 | 0.6306 | 0.6125 | 0.6098 | 0.6064 |
|  | MAD2L1 | SURV | H2AFZ | RRM2 | ANTXR1 | KI_67 | CDC2 | LOXL2 | TGFBR2 | NEK2 |
| TMEPAI | 0.6019 | 0.5979 | 0.5314 | 0.5176 | 0.5122 | 0.5071 | 0.4933 | 0.4871 | −0.481 | 0.4805 |
|  | VIM | THBS1 | TAGLN | MYLK | ENO1 | KI_67 | CDC2 | NME1 | TGFBR2 | NEK2 |
| TMSB10 | 0.6549 | 0.64 | 0.6343 | 0.6335 | 0.6271 | 0.6221 | 0.6219 | 0.616 | 0.6146 | 0.5982 |
|  | NKD | THBS1 | TAGLN | MYLK | NRP2 | IGFBP5 | CALD1 | CTGF | COL1A2 | DLC1 |
| TOP2A | 0.5264 | 0.5239 | 0.4626 | −0.4341 | −0.4322 | −0.4302 | VEGFB | PTCH | STMY3 | IGFBP7 |
|  | NKD | TGFB1 | ATP5E | TS | REG4 | ATP5A1 | 0.4282 | 0.4207 | 0.4173 | 0.4093 |
| TP | 0.6212 | 0.5169 | 0.5159 | 0.478 | 0.4447 | 0.4332 | −0.4296 | 0.427 | 0.422 | P21 |
|  | ENO1 | ANXA2 | PKR2 | TLN1 | UBE2M | RHOC | C20ORF126 | SBA2 | TP | 0.4205 |
| TS | 0.6143 | 0.4655 | 0.4571 | 0.4544 | 0.4375 | 0.4341 | 0.4194 | 0.4151 | 0.3996 | C20_ORF1 |
|  | CDC6 | CENPF | BRCA1 | NME1 | SURV | KIFC1 | MYBL2 | BUB1 | AURKB | 0.3958 |
| TP | 0.6975 | 0.6434 | 0.6321 | 0.6191 | 0.598 | 0.5636 | 0.5461 | 0.5406 | 0.538 | TIMP1 |
|  | CTSL | GBP2 | CD18 | SOD2 | DPYD | CIAP2 | CTSB | UPA | CD68 | 0.5303 |
| TS | 0.6975 | 0.6434 | 0.6321 | 0.6191 | 0.598 | 0.5636 | 0.5461 | 0.5406 | 0.538 | LMNB1 |
|  | ATP5A1 | CDC20 | AURKB | DHFR | PKR2 | TMEPAI | ATP5E | RAD54L | REG4 | 0.417 |
| UBE2C | 0.5525 | 0.4872 | 0.4854 | 0.4849 | 0.4591 | −0.4341 | −0.4303 | 0.4291 | 0.4205 | ATP5E |
|  | CSEL1 | STK15 | MYBL2 | C20_ORF1 | E2F1 | MCM2 | CDC2 | EREG | C20ORF126 | 0.378 |
| UNC5B | 0.6581 | 0.6551 | 0.5006 | 0.4835 | 0.4385 | 0.411 | 0.4031 | 0.3927 | 0.3874 | ADAMTS12 |
|  | THY1 | BGN | ANTXR1 | TGFB3 | TIMP2 | SPARC | IGFBP7 | HSPG2 | COL1A1 | 0.4958 |
| UPA | 0.5755 | 0.5594 | 0.5589 | 0.5417 | 0.5283 | 0.5236 | 0.5191 | 0.5055 | 0.4997 | TIMP1 |
|  | CTSL | INHBA | ANTXR1 | ITGA5 | COL1A2 | SPARC | CTHRC1 | BGN | COL1A1 | 0.6013 |
| VCL | 0.6558 | 0.6399 | 0.639 | 0.6357 | 0.629 | 0.6223 | 0.6173 | 0.6109 | 0.6014 | THBS1 |
|  | TAGLN | SPARC | THBS1 | TLN1 | COL1A2 | CDH11 | COL1A2 | HSPG2 | THBS1 | IGFBP7 |
|  | 0.6246 | 0.6024 | 0.5972 | 0.581 | 0.5726 | 0.5583 | 0.5515 | 0.5512 | 0.5494 | 0.544 |

TABLE 4-continued

Most Highly Correlated Genes

| Variable | Rank 1 | Rank 2 | Rank 3 | Rank 4 | Rank 5 | Rank 6 | Rank 7 | Rank 8 | Rank 9 | Rank 10 |
|---|---|---|---|---|---|---|---|---|---|---|
| VCP | CAPG 0.5823 | BAD 0.5384 | NOTCH1 0.4991 | GSK3B 0.4936 | H2AFZ 0.4724 | MAD2L1 0.4564 | TUFM 0.437 | KI_67 0.4343 | IGFBP7 0.4286 | RCC1 0.4176 |
| VDAC2 | HDAC1 0.5109 | SLC25A3 0.4867 | HNRPAB 0.4316 | PKR2 0.4196 | TS 0.3748 | SEMA4B 0.3883 | CHK1 0.364 | CKS2 0.3575 | CDC2 0.353 | CCNB1 0.3506 |
| VEGFB | IGFBP7 0.6369 | TAGLN 0.5024 | THY1 0.4866 | PTP4A3_V2 0.478 | IGFBP5 0.4614 | PTCH 0.4445 | CDH11 0.4398 | BAD 0.4357 | CAPG 0.4327 | TMEPAI 0.4282 |
| VEGF | VEGF_ALTSPLICE1 0.6894 | VEGF_ALTSPLICE2 0.5931 | HSPA1B 0.3855 | EFNA1 0.358 | CLAUDIN_4 0.3175 | STC1 0.3044 | AXIN1 0.2826 | TERC 0.2711 | MGAT5 0.258 | CDCA7_V2 0.2354 |
| VEGF_ALTSPLICE1 | VEGF_ALTSPLICE2 0.7502 | VEGF 0.6894 | CMYC 0.3686 | THBS1 0.3599 | EFNA1 0.3577 | NEDD8 -0.3552 | CLIC1 0.3464 | NOTCH1 0.3459 | CDCA7_V2 0.3414 | TMSB10 0.3389 |
| VEGF_ALTSPLICE2 | VEGF_ALTSPLICE1 0.7502 | VEGF 0.5931 | ITGB1 0.4269 | THBS1 0.4235 | CTGF 0.407 | TP53BP2 0.402 | CLIC1 0.3923 | MGAT5 0.3788 | EFNA1 0.3739 | HIF1A 0.3704 |
| VIM | COL1A2 0.6897 | SPARC 0.6773 | CTGF 0.6747 | THBS1 0.6723 | BGN 0.6625 | MMP2 0.6556 | TLN1 0.6549 | NRP2 0.6532 | TAGLN 0.6463 | CDH11 0.6376 |
| WISP1 | BGN 0.7682 | COL1A1 0.7442 | TIMP2 0.7263 | FAP 0.7147 | SPARC 0.694 | ANTXR1 0.6679 | CTHRC1 0.666 | TGFB3 0.6652 | INHBA 0.6599 | SFRP2 0.6292 |
| WNT2 | THY1 0.5223 | ANTXR1 0.5044 | BGN 0.4897 | SFRP4 0.4823 | CDH11 0.4823 | TIMP2 0.4699 | IGFBP7 0.4484 | SPARC 0.4412 | COL1A1 0.4381 | ADAMTS12 0.4268 |

TABLE 5

Results of Identification of Genes Through Gene Module/Clique Analysis of Validated Gene Biomarkers

| Validated Gene | Co-expressed genes (Pearson co-expression coefficient) | | | | | | |
|---|---|---|---|---|---|---|---|
| AXIN2 | NKD (0.72) | CDX2 (0.66) | CRIPTO [TDGF1] (0.64) | EPHB2 (0.56) | PTCH (0.50) | ROCK2 (0.49) | CAD17 (0.45) |
| | CDCA7 (0.45) | MGAT5 (0.41) | PTP4A3 (0.40) | | | | |
| BGN | COL1A1 (0.90) | SPARC (0.87) | TIMP2 (0.84) | FAP (0.82) | ANTXR1 (0.82) | TGFB3 (0.81) | SFRP2 (0.81) |
| | INHBA (0.79) | WISP1 (0.77) | CTHRC1 (0.77) | LOXL2 (0.74) | COL1A2 (0.74) | THY1 (0.74) | CDH11 (0.73) |
| | TIMP3 (0.71) | ADAMTS12 (0.70) | LOX (0.70) | CTGF (0.69) | CXCL12 (0.68) | PDGFC (0.68) | |
| cMYC | HSPE1 (0.55) | NME1 (0.49) | TERC (0.48) | EREG (0.47) | AREG (.046) | NOTCH1 (0.46) | MYBL2 (0.45) |
| | CSEL1 (0.45) | C_SRC (0.44) | SNRPF (0.44) | E2F1 (0.44) | ATP5E (0.44) | UMPS (0.43) | PRDX4 (0.40) |
| | CDX2 (0.40) | MAD2L1 (0.40) | | | | | |
| EFNB2 | LAMC2 (0.46) | KLF5 (0.43) | SPRY2 (0.42) | | | | |
| FAP | BGN (0.82) | COL1A1 (0.78) | CTHRC1 (0.77) | TIMP2 (0.74) | INHBA (0.73) | ANTXR1 (0.73) | SFRP2 (0.72) |
| | WISP1 (0.72) | TIMP3 (0.70) | TGFB3 (0.70) | SPARC (0.67) | LOXL2 (0.64) | SFRP4 (0.63) | COL1A2 (0.62) |
| | CYP1B1 (0.62) | CDH11 (0.61) | CTSB (0.61) | PDGFC (0.59) | CXCL12 (0.59) | MCP1 (0.59) | |
| GADD45B | DUSP1 (0.59) | PAI1 (0.58) | CTGF (0.58) | CYR61 (0.53) | INHBA (0.56) | BGN (0.52) | SPARC (0.51) |
| | UPA (0.50) | THBS1 (0.50) | PLK3 (0.49) | TIMP1 (0.49) | SFRP2 (0.48) | CYP1B1 (0.47) | VIM (0.47) |
| | LOX (0.46) | TAGLN (0.46) | CXCL12 (0.46) | WISP1 (0.46) | TGFB3 (0.45) | STC1 (0.45) | |
| HSPE1 | CCNB1 (0.57) | CMYC (0.55) | NME1 (0.53) | SNRPF (0.52) | HNRPAB (0.50) | RRM2 (0.48) | RBX1 (0.48) |
| | ODC1 (0.47) | MAD2L1 (0.46) | MSH2 (0.41) | AREG (0.41) | HSPA8 (0.41) | CD44E (0.40) | THY1 (0.40) |
| INHBA | BGN (0.79) | SPARC (0.77) | CTHRC1 (0.74) | FAP (0.73) | COL1A1 (0.72) | CTGF (0.71) | COL1A2 (0.72) |
| | CDH11 (0.67) | THBS1 (0.67) | LOXL2 (0.66) | TIMP2 (0.66) | WISP1 (0.66) | SFRP2 (0.64) | UPA (0.64) |
| | TIMP3 (0.64) | ANTXR1 (0.64) | CYR61 (0.63) | PAI1 (0.61) | PDGFC (0.61) | ADAMTS12 (0.61) | |
| Ki67 | CDC2 (0.69) | MAD2L1 (0.60) | H2AFZ (0.58) | BUB1 (0.54) | CDC20 (0.52) | SURV (0.51) | TK1 (0.51) |
| | NEK2 (0.51) | LMNB1 (0.50) | RRM2 (0.48) | SNRPF (0.47) | CCNB1 (0.47) | KIFC1 (0.46) | RAD54L (0.46) |
| | ESPL1 (0.46) | PCNA (0.45) | KIF22 (0.44) | CDC25C (0.44) | VCP (0.43) | MCM3 (0.43) | |
| MAD2L1 | H2AFZ (0.64) | CDC2 (0.62) | SNRPF (0.61) | TK1 (0.60) | KI_67 (0.60) | SURV (0.58) | CCNB1 (0.57) |
| | RRM2 (0.56) | NEK2 (0.55) | BUB1 (0.53) | NME1 (0.51) | MCM3 (0.49) | BAD (0.47) | HSPE1 (0.46) |
| | VCP (0.44) | TGFBR2 (0.45) | KRT8 (0.44) | PCNA (0.44) | CDC20 (0.43) | RCC1 (0.43) | |
| MYBL2 | C20_ORF1 (0.56) | E2F1 (0.55) | UBE2C (0.50) | STK15 (0.46) | CSEL1 (0.46) | CMYC (0.52) | ATP5E (0.42) |
| | TOP2A (0.42) | CDCA7 (0.41) | | | | | |
| RUNX1 | CDH11 (0.57) | TIMP2 (0.55) | PDGFC (0.54) | ANTXR1 (0.53) | BGN (0.52) | CALD1 (0.52) | FZD1 (0.51) |
| | SPARC (0.50) | IGFBP7 (0.50) | INHBA (0.50) | NRP2 (0.49) | AKT3 (0.49) | SFRP4 (0.49) | COL1A2 (0.49) |
| | CTHRC1 (0.48) | FAP (0.48) | WISP1 (0.48) | TGFB3 (0.47) | TAGLN (0.47) | TIMP3 (0.47) | |

TABLE 6

Gene Cliques Identified for Validated Genes

| Seeding Gene | AffyProbeID | Weight | Cliqued Gene | Spearman Cutoff |
|---|---|---|---|---|
| FAP | 9441 | 19 | FAP | 0.5 |
| FAP | 13949 | 4 | DKFZp434K191 | 0.5 |
| FAP | 13949 | 4 | POM121L1 | 0.5 |
| FAP | 13949 | 4 | LOC646074 | 0.5 |
| FAP | 13949 | 4 | LOC100133536 | 0.5 |
| FAP | 13949 | 4 | LOC651452 | 0.5 |
| FAP | 13949 | 4 | LOC729915 | 0.5 |
| FAP | 13949 | 4 | DKFZP434P211 | 0.5 |
| FAP | 13949 | 4 | LOC728093 | 0.5 |
| FAP | 7405 | 3 | CALCR | 0.5 |
| FAP | 9568 | 3 | TPSAB1 | 0.5 |
| FAP | 10493 | 3 | TLX2 | 0.5 |
| FAP | 15164 | 3 | — | 0.5 |
| FAP | 15197 | 3 | NUDT7 | 0.5 |
| FAP | 16536 | 3 | IGHA1 | 0.5 |
| FAP | 20381 | 3 | LRRC3 | 0.5 |
| FAP | 4496 | 2 | RDX | 0.5 |
| FAP | 4839 | 2 | SPI1 | 0.5 |
| FAP | 6242 | 2 | UMOD | 0.5 |
| FAP | 9590 | 2 | RDH5 | 0.5 |
| FAP | 15576 | 2 | COMT | 0.5 |
| FAP | 16692 | 2 | — | 0.5 |
| FAP | 18423 | 2 | LYVE1 | 0.5 |
| FAP | 6479 | 1 | LPHN2 | 0.5 |
| FAP | 10429 | 1 | HLA-DRA | 0.5 |
| FAP | 16097 | 1 | STK38 | 0.5 |
| FAP | 19846 | 1 | SERGEF | 0.5 |
| FAP | 20724 | 1 | OMP | 0.5 |
| HSPE1 | 4660 | 569 | HSPE1 | 0.5 |
| HSPE1 | 15676 | 338 | YME1L1 | 0.5 |
| HSPE1 | 746 | 302 | CTBP2 | 0.5 |
| HSPE1 | 1358 | 265 | NET1 | 0.5 |
| HSPE1 | 1697 | 174 | AASDHPPT | 0.5 |
| HSPE1 | 17578 | 146 | C11orf10 | 0.5 |
| HSPE1 | 18720 | 139 | CHMP5 | 0.5 |
| HSPE1 | 12550 | 138 | SP3 | 0.5 |
| HSPE1 | 10354 | 133 | PDCD10 | 0.5 |
| HSPE1 | 879 | 132 | YME1L1 | 0.5 |
| HSPE1 | 8855 | 123 | MED21 | 0.5 |
| HSPE1 | 1181 | 102 | CNIH | 0.5 |
| HSPE1 | 17414 | 98 | MRPL13 | 0.5 |
| HSPE1 | 471 | 97 | HMGN1 | 0.5 |
| HSPE1 | 17704 | 96 | MRPL22 | 0.5 |
| HSPE1 | 13816 | 95 | SHMT2 | 0.5 |
| HSPE1 | 10513 | 85 | SUMO1 | 0.5 |
| HSPE1 | 22252 | 81 | — | 0.5 |
| HSPE1 | 8637 | 79 | CLNS1A | 0.5 |
| HSPE1 | 9151 | 74 | CETN3 | 0.5 |
| HSPE1 | 92 | 73 | SMNDC1 | 0.5 |
| HSPE1 | 437 | 72 | RPLP2 | 0.5 |
| HSPE1 | 3713 | 63 | PPID | 0.5 |
| HSPE1 | 3111 | 62 | TTC35 | 0.5 |
| HSPE1 | 20668 | 60 | UGT1A9 | 0.5 |
| HSPE1 | 20668 | 60 | UGT1A6 | 0.5 |
| HSPE1 | 20668 | 60 | UGT1A8 | 0.5 |
| HSPE1 | 11526 | 54 | PDS5A | 0.5 |
| HSPE1 | 108 | 53 | TMED2 | 0.5 |
| HSPE1 | 12094 | 52 | NUP160 | 0.5 |
| HSPE1 | 8110 | 48 | PDIA3 | 0.5 |
| HSPE1 | 17336 | 48 | MAP2K1IP1 | 0.5 |
| HSPE1 | 11983 | 47 | WDFY3 | 0.5 |
| HSPE1 | 17192 | 45 | SPG21 | 0.5 |
| HSPE1 | 495 | 39 | PPIB | 0.5 |
| HSPE1 | 17591 | 39 | NDUFB4 | 0.5 |
| HSPE1 | 17591 | 39 | LOC727762 | 0.5 |
| HSPE1 | 9287 | 37 | PRKAA1 | 0.5 |
| HSPE1 | 31 | 35 | RPL11 | 0.5 |
| HSPE1 | 19126 | 30 | RPL36 | 0.5 |
| HSPE1 | 166 | 29 | YWHAZ | 0.5 |
| HSPE1 | 8914 | 29 | MSH2 | 0.5 |
| HSPE1 | 1060 | 28 | PSMA3 | 0.5 |
| HSPE1 | 21589 | 26 | LOC441533 | 0.5 |
| HSPE1 | 1241 | 25 | RANBP2 | 0.5 |
| HSPE1 | 7592 | 24 | ITGB6 | 0.5 |
| HSPE1 | 20791 | 24 | TBL1XR1 | 0.5 |
| HSPE1 | 2992 | 23 | MRPL19 | 0.5 |
| HSPE1 | 4412 | 23 | MSLN | 0.5 |
| HSPE1 | 801 | 22 | hCG_1781062 | 0.5 |
| HSPE1 | 801 | 22 | SRP9 | 0.5 |
| HSPE1 | 17967 | 22 | FAM29A | 0.5 |
| HSPE1 | 8189 | 20 | PRKDC | 0.5 |
| HSPE1 | 15646 | 18 | SEC11A | 0.5 |
| HSPE1 | 120 | 16 | RPS3A | 0.5 |
| HSPE1 | 120 | 16 | LOC439992 | 0.5 |
| HSPE1 | 112 | 14 | RPS25 | 0.5 |
| HSPE1 | 395 | 14 | ZNF313 | 0.5 |
| HSPE1 | 8347 | 14 | CANX | 0.5 |
| HSPE1 | 11315 | 14 | TUT1 | 0.5 |
| HSPE1 | 11315 | 14 | EEF1G | 0.5 |
| HSPE1 | 8766 | 13 | NAB1 | 0.5 |
| HSPE1 | 18447 | 13 | SHQ1 | 0.5 |
| HSPE1 | 1170 | 12 | IFNGR2 | 0.5 |
| HSPE1 | 19696 | 12 | CLDN16 | 0.5 |
| HSPE1 | 17528 | 11 | MCTS1 | 0.5 |
| HSPE1 | 38 | 10 | RPS27A | 0.5 |
| HSPE1 | 38 | 10 | UBC | 0.5 |
| HSPE1 | 38 | 10 | UBB | 0.5 |
| HSPE1 | 309 | 10 | RPS15A | 0.5 |
| HSPE1 | 10762 | 10 | EEF1G | 0.5 |
| HSPE1 | 10762 | 10 | TUT1 | 0.5 |
| HSPE1 | 4819 | 9 | HNRNPA2B1 | 0.5 |
| HSPE1 | 10894 | 9 | RPS17 | 0.5 |
| HSPE1 | 20002 | 9 | CBLC | 0.5 |
| HSPE1 | 4294 | 8 | FEN1 | 0.5 |
| HSPE1 | 417 | 7 | SSR1 | 0.5 |
| HSPE1 | 3271 | 6 | HMGB3 | 0.5 |
| HSPE1 | 7814 | 6 | C7orf28A | 0.5 |
| HSPE1 | 7814 | 6 | C7orf28B | 0.5 |
| HSPE1 | 11918 | 6 | WEE1 | 0.5 |
| HSPE1 | 3474 | 5 | CSTF3 | 0.5 |
| HSPE1 | 19605 | 5 | TMCO3 | 0.5 |
| HSPE1 | 231 | 4 | DYNLL1 | 0.5 |
| HSPE1 | 296 | 4 | MAT2A | 0.5 |
| HSPE1 | 863 | 4 | ARHGEF12 | 0.5 |
| HSPE1 | 4185 | 4 | TRA2A | 0.5 |
| HSPE1 | 18483 | 4 | LSM8 | 0.5 |
| HSPE1 | 21253 | 3 | ADCK2 | 0.5 |
| HSPE1 | 926 | 2 | LOC100130862 | 0.5 |
| HSPE1 | 926 | 2 | TRAM1 | 0.5 |
| HSPE1 | 4761 | 2 | SLC16A4 | 0.5 |
| HSPE1 | 19884 | 2 | NUP62CL | 0.5 |
| HSPE1 | 47 | 1 | RPL34 | 0.5 |
| HSPE1 | 1155 | 1 | INSIG1 | 0.5 |
| HSPE1 | 2415 | 1 | DDIT4 | 0.5 |
| HSPE1 | 3473 | 1 | ARG2 | 0.5 |
| HSPE1 | 11997 | 1 | RCOR1 | 0.5 |
| HSPE1 | 16678 | 1 | — | 0.5 |
| INHBA | 9981 | 4 | INHBA | 0.5 |
| INHBA | 1386 | 2 | SRGN | 0.5 |
| INHBA | 21897 | 2 | COL11A1 | 0.5 |
| INHBA | 1320 | 1 | AEBP1 | 0.5 |
| INHBA | 5099 | 1 | ANGPT2 | 0.5 |
| INHBA | 5939 | 1 | TCL6 | 0.5 |
| INHBA | 5939 | 1 | TCL1B | 0.5 |
| INHBA | 9047 | 1 | CD36 | 0.5 |
| MAD2L1 | 2889 | 5 | MAD2L1 | 0.5 |
| MAD2L1 | 4862 | 3 | SRP19 | 0.5 |
| MAD2L1 | 3962 | 2 | NUPL1 | 0.5 |
| MAD2L1 | 4484 | 2 | ORC5L | 0.5 |
| MAD2L1 | 12103 | 2 | PAPOLA | 0.5 |
| MAD2L1 | 2863 | 1 | ITGB1BP1 | 0.5 |
| KI67 | 11408 | 15 | KI67 | 0.5 |
| KI67 | 11409 | 15 | KI67 | 0.5 |
| KI67 | 11406 | 14 | KI67 | 0.5 |
| KI67 | 986 | 13 | BUB3 | 0.5 |
| KI67 | 9460 | 10 | BUB3 | 0.5 |
| KI67 | 8882 | 9 | DBI | 0.5 |
| KI67 | 320 | 8 | XRCC6 | 0.5 |
| KI67 | 1717 | 8 | PTBP1 | 0.5 |
| KI67 | 7951 | 8 | XPNPEP1 | 0.5 |

TABLE 6-continued

Gene Cliques Identified for Validated Genes

| Seeding Gene | AffyProbeID | Weight | Cliqued Gene | Spearman Cutoff |
|---|---|---|---|---|
| KI67 | 8574 | 7 | GLRX3 | 0.5 |
| KI67 | 11181 | 7 | SFRS1 | 0.5 |
| KI67 | 11407 | 7 | KI67 | 0.5 |
| KI67 | 17827 | 7 | BXDC5 | 0.5 |
| KI67 | 100 | 5 | KARS | 0.5 |
| KI67 | 2694 | 5 | CFDP1 | 0.5 |
| KI67 | 12471 | 5 | DNAJC9 | 0.5 |
| KI67 | 484 | 4 | SSRP1 | 0.5 |
| KI67 | 791 | 4 | TARS | 0.5 |
| KI67 | 1005 | 4 | RRM1 | 0.5 |
| KI67 | 1622 | 4 | BIRC5 | 0.5 |
| KI67 | 17411 | 4 | MRPS16 | 0.5 |
| KI67 | 424 | 3 | HDGF | 0.5 |
| KI67 | 1083 | 3 | MCM3 | 0.5 |
| KI67 | 2427 | 3 | SFRS3 | 0.5 |
| KI67 | 2738 | 3 | RFC5 | 0.5 |
| KI67 | 3271 | 3 | HMGB3 | 0.5 |
| KI67 | 8303 | 3 | HMGB2 | 0.5 |
| KI67 | 9311 | 3 | UCK2 | 0.5 |
| KI67 | 12916 | 3 | UBE2I | 0.5 |
| KI67 | 17225 | 3 | NDUFA10 | 0.5 |
| KI67 | 17225 | 3 | LOC732160 | 0.5 |
| KI67 | 17720 | 3 | KIF4A | 0.5 |
| KI67 | 19014 | 3 | ERCC6L | 0.5 |
| KI67 | 1298 | 2 | SNRPA | 0.5 |
| KI67 | 1302 | 2 | NCAPD2 | 0.5 |
| KI67 | 1424 | 2 | PSRC1 | 0.5 |
| KI67 | 3779 | 2 | CDK2 | 0.5 |
| KI67 | 6025 | 2 | SNHG3-RCC1 | 0.5 |
| KI67 | 6025 | 2 | RCC1 | 0.5 |
| KI67 | 8746 | 2 | HARS2 | 0.5 |
| KI67 | 17338 | 2 | DCXR | 0.5 |
| KI67 | 17441 | 2 | ARHGAP17 | 0.5 |
| KI67 | 17907 | 2 | CEP55 | 0.5 |
| KI67 | 18151 | 2 | CWF19L1 | 0.5 |
| KI67 | 899 | 1 | CUL3 | 0.5 |
| KI67 | 1381 | 1 | CDC25B | 0.5 |
| KI67 | 3033 | 1 | MED12 | 0.5 |
| KI67 | 8957 | 1 | AURKB | 0.5 |
| KI67 | 9538 | 1 | TAF5 | 0.5 |
| KI67 | 11401 | 1 | PTBP1 | 0.5 |
| KI67 | 13174 | 1 | NGDN | 0.5 |
| KI67 | 18311 | 1 | PAPD1 | 0.5 |
| KI67 | 19342 | 1 | NUSAP1 | 0.5 |
| RUNX1 | 10265 | 38 | RUNX1 | 0.6 |
| RUNX1 | 10621 | 21 | RUNX1 | 0.6 |
| RUNX1 | 10624 | 11 | RUNX1 | 0.6 |
| RUNX1 | 16111 | 11 | — | 0.6 |
| RUNX1 | 15586 | 10 | — | 0.6 |
| RUNX1 | 7955 | 9 | GABRD | 0.6 |
| RUNX1 | 13947 | 9 | TPSD1 | 0.6 |
| RUNX1 | 16761 | 9 | — | 0.6 |
| RUNX1 | 6124 | 8 | INS | 0.6 |
| RUNX1 | 9341 | 8 | KLK2 | 0.6 |
| RUNX1 | 15333 | 8 | F12 | 0.6 |
| RUNX1 | 15717 | 8 | SEC14L3 | 0.6 |
| RUNX1 | 19749 | 8 | JPH2 | 0.6 |
| RUNX1 | 2021 | 7 | CSH1 | 0.6 |
| RUNX1 | 2021 | 7 | CSH2 | 0.6 |
| RUNX1 | 2021 | 7 | GH1 | 0.6 |
| RUNX1 | 2021 | 7 | FCHO2 | 0.6 |
| RUNX1 | 14776 | 7 | APPBP2 | 0.6 |
| RUNX1 | 16935 | 7 | — | 0.6 |
| RUNX1 | 13242 | 6 | PNPLA2 | 0.6 |
| RUNX1 | 17026 | 6 | SIX5 | 0.6 |
| RUNX1 | 7844 | 5 | CSH1 | 0.6 |
| RUNX1 | 7844 | 5 | GH1 | 0.6 |
| RUNX1 | 7844 | 5 | CSH2 | 0.6 |
| RUNX1 | 7907 | 5 | GRAP2 | 0.6 |
| RUNX1 | 10097 | 5 | SGCA | 0.6 |
| RUNX1 | 4397 | 4 | PCSK2 | 0.6 |
| RUNX1 | 8058 | 4 | KCNA10 | 0.6 |
| RUNX1 | 9957 | 4 | CLEC4M | 0.6 |
| RUNX1 | 14240 | 4 | DOT1L | 0.6 |
| RUNX1 | 20209 | 4 | ACOXL | 0.6 |
| RUNX1 | 7167 | 3 | CDY2A | 0.6 |
| RUNX1 | 7167 | 3 | CDY1 | 0.6 |
| RUNX1 | 7167 | 3 | CDY2B | 0.6 |
| RUNX1 | 7167 | 3 | CDY1B | 0.6 |
| RUNX1 | 7985 | 3 | LMX1B | 0.6 |
| RUNX1 | 8006 | 3 | OR2J2 | 0.6 |
| RUNX1 | 8070 | 3 | HIST3H3 | 0.6 |
| RUNX1 | 11037 | 3 | IGHG1 | 0.6 |
| RUNX1 | 11044 | 3 | IGHG1 | 0.6 |
| RUNX1 | 11044 | 3 | LOC100133862 | 0.6 |
| RUNX1 | 11044 | 3 | IGHA1 | 0.6 |
| RUNX1 | 13294 | 3 | NKG7 | 0.6 |
| RUNX1 | 14153 | 3 | IGKV4-1 | 0.6 |
| RUNX1 | 14518 | 3 | — | 0.6 |
| RUNX1 | 16170 | 3 | — | 0.6 |
| RUNX1 | 16401 | 3 | KRT84 | 0.6 |
| RUNX1 | 19748 | 3 | TXNDC3 | 0.6 |
| RUNX1 | 19870 | 3 | GUCY1B2 | 0.6 |
| RUNX1 | 6932 | 2 | LECT2 | 0.6 |
| RUNX1 | 9485 | 2 | SOCS1 | 0.6 |
| RUNX1 | 10358 | 2 | ID2B | 0.6 |
| RUNX1 | 11241 | 2 | PVRL1 | 0.6 |
| RUNX1 | 11266 | 2 | PCDHGA11 | 0.6 |
| RUNX1 | 14875 | 2 | — | 0.6 |
| RUNX1 | 15862 | 2 | IGHM | 0.6 |
| RUNX1 | 16087 | 2 | FAM48A | 0.6 |
| RUNX1 | 16200 | 2 | LOC390561 | 0.6 |
| RUNX1 | 16200 | 2 | LOC730909 | 0.6 |
| RUNX1 | 16568 | 2 | RASAL2 | 0.6 |
| RUNX1 | 16937 | 2 | — | 0.6 |
| RUNX1 | 18968 | 2 | ZNF3 | 0.6 |
| RUNX1 | 20168 | 2 | TP73 | 0.6 |
| RUNX1 | 21214 | 2 | PKP1 | 0.6 |
| RUNX1 | 3849 | 1 | GOLIM4 | 0.6 |
| RUNX1 | 5706 | 1 | ZNF747 | 0.6 |
| RUNX1 | 7412 | 1 | SRY | 0.6 |
| RUNX1 | 7412 | 1 | LOC100130809 | 0.6 |
| RUNX1 | 13490 | 1 | OPCML | 0.6 |
| RUNX1 | 13739 | 1 | SMARCA4 | 0.6 |
| RUNX1 | 13844 | 1 | ORM1 | 0.6 |
| RUNX1 | 13844 | 1 | ORM2 | 0.6 |
| RUNX1 | 15714 | 1 | PCDHGA3 | 0.6 |
| RUNX1 | 19633 | 1 | ZBBX | 0.6 |
| RUNX1 | 20562 | 1 | GFRA4 | 0.6 |
| RUNX1 | 21537 | 1 | SCAND2 | 0.6 |
| RUNX1 | 21554 | 1 | LOC100132923 | 0.6 |

TABLE 7

Datasets used for gene clique analysis of prognostic and predictive genes

| GEO Accession Number | Number of Tumor Samples |
|---|---|
| GSE1323 | 6 |
| GSE2138 | 20 |
| GSE2509 | 6 |
| GSE2742 | 27 |
| GSE5364 | 9 |

TABLE 8

Association of gene expression and risk of recurrence in surgery alone patients from the QUASAR study

| Gene | N | HR | HR 95% CI | LR p-value |
|---|---|---|---|---|
| Axin_2 | 711 | 1.13 | (1.00, 1.28) | 0.046 |
| BIK | 711 | 0.61 | (0.47, 0.80) | 0.0002 |
| EFNB2 | 711 | 1.71 | (1.40, 2.08) | 3.9E-07 |
| HSPE1 | 711 | 0.75 | (0.56, 1.00) | 0.054 |
| MAD2L1 | 711 | 0.66 | (0.52, 0.84) | 0.0006 |
| RUNX1 | 711 | 1.76 | (1.37, 2.26) | 7.6E-06 |
| BGN | 711 | 1.31 | (1.11, 1.55) | 0.001 |
| FAP | 711 | 1.48 | (1.16, 1.87) | 0.002 |
| INHBA | 711 | 1.35 | (1.13, 1.62) | 0.001 |
| Ki_67 | 711 | 0.63 | (0.47, 0.83) | 0.001 |
| MYBL2 | 711 | 0.98 | (0.74, 1.28) | 0.86 |
| cMYC | 711 | 0.93 | (0.79, 1.11) | 0.44 |
| GADD45B | 711 | 1.17 | (0.95, 1.44) | 0.14 |

TABLE 9

Results of the meta analysis and stratified Cox models

| Gene | META analysis HR | META analysis 95% CI | Stratified Cox Model HR | Stratified Cox Model 95% CI |
|---|---|---|---|---|
| Axin_2 | 0.99 | (0.89, 1.09) | 1.00 | (0.95, 1.05) |
| BIK | 0.75 | (0.64, 0.88) | 0.74 | (0.65, 0.83) |
| EFNB2 | 1.37 | (1.23, 1.54) | 1.38 | (1.26, 1.52) |
| HSPE1 | 0.77 | (0.67, 0.88) | 0.80 | (0.73, 0.89) |
| MAD2L1 | 0.67 | (0.61, 0.75) | 0.67 | (0.61, 0.75) |
| RUNX1 | 1.38 | (1.14, 1.68) | 1.38 | (1.23, 1.55) |
| BGN | 1.29 | (1.19, 1.39) | 1.28 | (1.19, 1.38) |
| INHBA | 1.29 | (1.19, 1.39) | 1.29 | (1.19, 1.39) |
| FAP | 1.23 | (1.15, 1.31) | 1.24 | (1.15, 1.34) |
| Ki_67 | 0.74 | (0.69, 0.81) | 0.75 | (0.68, 0.84) |
| cMYC | 0.84 | (0.78, 0.90) | 0.83 | (0.76, 0.90) |
| MYBL2 | 0.86 | (0.79, 0.93) | 0.86 | (0.80, 0.94) |
| GADD45B | 1.20 | (1.12, 1.29) | 1.23 | (1.11, 1.37) |

SEQUENCE LISTING (3028 sequences)

SEQ ID NO: 1 - DNA, 23 bp, Artificial Sequence
  Synthetic oligonucleotide
cgttccgatcctctatactgcat

SEQ ID NO: 2 - DNA, 25 bp, Artificial Sequence
  Synthetic oligonucleotide
atgcctacagcaccctgatgtcgca

SEQ ID NO: 3 - DNA, 22 bp, Artificial Sequence
  Synthetic oligonucleotide
aggtccctgttggccttatagg

SEQ ID NO: 4 - DNA, 20 bp, Artificial Sequence
  Synthetic oligonucleotide
aaacaccactggagcattga

SEQ ID NO: 5 - DNA, 24 bp, Artificial Sequence
  Synthetic oligonucleotide
ctcgccaatgatgctgctcaagtt

SEQ ID NO: 6 - DNA, 20 bp, Artificial Sequence
  Synthetic oligonucleotide
caagcctggaacctatagcc

SEQ ID NO: 7 - DNA, 20 bp, Artificial Sequence
  Synthetic oligonucleotide
tgcagactgtaccatgctga

SEQ ID NO: 8 - DNA, 22 bp, Artificial Sequence
  Synthetic oligonucleotide
ctgcacacggttctaggctccg

SEQ ID NO: 9 - DNA, 20 bp, Artificial Sequence
  Synthetic oligonucleotide
ggccagcaccataatcctat

SEQ ID NO: 10 - DNA, 18 bp, Artificial Sequence
  Synthetic oligonucleotide
ggatgaacctcgacctgc

SEQ ID NO: 11 - DNA, 24 bp, Artificial Sequence
  Synthetic oligonucleotide
ccagatagcctcgtccgagtgctc

SEQ ID NO: 12 - DNA, 18 bp, Artificial Sequence
  Synthetic oligonucleotide
gagctgcaccgtctccag

SEQ ID NO: 13 - DNA, 19 bp, Artificial Sequence
  Synthetic oligonucleotide
gctaccaagtccgtgctgt

SEQ ID NO: 14 - DNA, 28 bp, Artificial Sequence
  Synthetic oligonucleotide
tgatcgacaaatgttacccagacacaca

SEQ ID NO: 15 - DNA, 20 bp, Artificial Sequence
  Synthetic oligonucleotide
gaaaactgcttctgcaatgg

SEQ ID NO: 16 - DNA, 20 bp, Artificial Sequence
  Synthetic oligonucleotide
cccatcaacttgtgccagta

SEQ ID NO: 17 - DNA, 24 bp, Artificial Sequence
  Synthetic oligonucleotide
tgcctactccactgcacagaccct

SEQ ID NO: 18 - DNA, 19 bp, Artificial Sequence
  Synthetic oligonucleotide
ggtgatggttcgaccactg

SEQ ID NO: 19 - DNA, 20 bp, Artificial Sequence
  Synthetic oligonucleotide
gaagtgccaggaggcgatta

SEQ ID NO: 20 - DNA, 28 bp, Artificial Sequence
  Synthetic oligonucleotide
tgctacttgcaaaggcgtgtcctactgc

SEQ ID NO: 21 - DNA, 21 bp, Artificial Sequence
  Synthetic oligonucleotide
cgggcactcactgctattacc

SEQ ID NO: 22 - DNA, 19 bp, Artificial Sequence
  Synthetic oligonucleotide
ggagaagggtggagtgcag

SEQ ID NO: 23 - DNA, 24 bp, Artificial Sequence
  Synthetic oligonucleotide
cgcacagtcagaatccatctgggt

SEQ ID NO: 24 - DNA, 20 bp, Artificial Sequence
  Synthetic oligonucleotide
cagggtcaggtctctggatg

SEQ ID NO: 25 - DNA, 20 bp, Artificial Sequence
  Synthetic oligonucleotide
ttgacaacctgctggacatc

SEQ ID NO: 26 - DNA, 24 bp, Artificial Sequence
  Synthetic oligonucleotide
ccctgagcagactgtaggccacct

SEQ ID NO: 27 - DNA, 20 bp, Artificial Sequence
  Synthetic oligonucleotide
atgggatccttgctgctatc

SEQ ID NO: 28 - DNA, 18 bp, Artificial Sequence
  Synthetic oligonucleotide
cttttccctccagtggca

SEQ ID NO: 29 - DNA, 24 bp, Artificial Sequence
  Synthetic oligonucleotide
ctcctggaaacagtccacttgggc

SEQ ID NO: 30 - DNA, 20 bp, Artificial Sequence
  Synthetic oligonucleotide
atttggaaggcactgggttt

SEQ ID NO: 31 - DNA, 20 bp, Artificial Sequence
  Synthetic oligonucleotide
tagagagcccctgacaatcc

SEQ ID NO: 32 - DNA, 25 bp, Artificial Sequence
  Synthetic oligonucleotide
tggctctagctcctgatgaagcctc

SEQ ID NO: 33 - DNA, 20 bp, Artificial Sequence
  Synthetic oligonucleotide
ggttggtcttggaaagagga

SEQ ID NO: 34 - DNA, 20 bp, Artificial Sequence
  Synthetic oligonucleotide
cgcttctatggcgctgagat

SEQ ID NO: 35 - DNA, 24 bp, Artificial Sequence
  Synthetic oligonucleotide
cagccctggactacctgcactcgg

SEQ ID NO: 36 - DNA, 20 bp, Artificial Sequence
  Synthetic oligonucleotide
tcccggtacaccacgttctt

SEQ ID NO: 37 - DNA, 19 bp, Artificial Sequence
  Synthetic oligonucleotide
tcctgccacccttcaaacc

SEQ ID NO: 38 - DNA, 24 bp, Artificial Sequence
  Synthetic oligonucleotide
caggtcacgtccgaggtcgacaca

SEQ ID NO: 39 - DNA, 21 bp, Artificial Sequence
  Synthetic oligonucleotide
ggcggtaaattcatcatcgaa

SEQ ID NO: 40 - DNA, 25 bp, Artificial Sequence
  Synthetic oligonucleotide
ttgtctctgccttggactatctaca

SEQ ID NO: 41 - DNA, 23 bp, Artificial Sequence
  Synthetic oligonucleotide
tcacggtacacaatctttccgga

SEQ ID NO: 42 - DNA, 24 bp, Artificial Sequence
  Synthetic oligonucleotide
ccagcattagattctccaacttga

SEQ ID NO: 43 - DNA, 21 bp, Artificial Sequence
  Synthetic oligonucleotide
caagaagaggctctaccctgg

SEQ ID NO: 44 - DNA, 24 bp, Artificial Sequence
  Synthetic oligonucleotide
actgggaatttccaaggccacctt

SEQ ID NO: 45 - DNA, 20 bp, Artificial Sequence
  Synthetic oligonucleotide
aaatgagctctgcgatcctc

SEQ ID NO: 46 - DNA, 21 bp, Artificial Sequence
  Synthetic oligonucleotide
gaggaatatggaatccaaggg

SEQ ID NO: 47 - DNA, 24 bp, Artificial Sequence
  Synthetic oligonucleotide
ccagttcctgccgtctgctcttct

SEQ ID NO: 48 - DNA, 18 bp, Artificial Sequence
  Synthetic oligonucleotide
gtggcggagatcaagagg

SEQ ID NO: 49 - DNA, 25 bp, Artificial Sequence
  Synthetic oligonucleotide
gaaggagataaggaggatgttgaca

SEQ ID NO: 50 - DNA, 26 bp, Artificial Sequence
  Synthetic oligonucleotide
agtgaaggccgcaagacaggcttttc

SEQ ID NO: 51 - DNA, 18 bp, Artificial Sequence
  Synthetic oligonucleotide
cgccacggagatccaatc

SEQ ID NO: 52 - DNA, 18 bp, Artificial Sequence
  Synthetic oligonucleotide
gcctgtacgtgccagctc

SEQ ID NO: 53 - DNA, 24 bp, Artificial Sequence
  Synthetic oligonucleotide
tgccagagcctcaactgtctctgc

SEQ ID NO: 54 - DNA, 19 bp, Artificial Sequence
  Synthetic oligonucleotide
tcatcggagcttgatctcg

SEQ ID NO: 55 - DNA, 21 bp, Artificial Sequence
  Synthetic oligonucleotide
gatggttcagctctgcaagga

SEQ ID NO: 56 - DNA, 30 bp, Artificial Sequence
  Synthetic oligonucleotide
cgatttgaatatctttccttctcgcccacc

SEQ ID NO: 57 - DNA, 18 bp, Artificial Sequence
  Synthetic oligonucleotide
tcgaccgtggctgctcat

SEQ ID NO: 58 - DNA, 20 bp, Artificial Sequence
  Synthetic oligonucleotide
ccgtgaaagctgctctgtaa

SEQ ID NO: 59 - DNA, 24 bp, Artificial Sequence
  Synthetic oligonucleotide
aagctgacacagccctcccaagtg

SEQ ID NO: 60 - DNA, 20 bp, Artificial Sequence
  Synthetic oligonucleotide
ttgcagtgggaagaacagtc

SEQ ID NO: 61 - DNA, 20 bp, Artificial Sequence
  Synthetic oligonucleotide
ctccaggtgtacctccaacc

SEQ ID NO: 62 - DNA, 24 bp, Artificial Sequence
  Synthetic oligonucleotide
agccttctcccacagctgcctaca

SEQ ID NO: 63 - DNA, 20 bp, Artificial Sequence
  Synthetic oligonucleotide
gagaaggctgggagactctg

SEQ ID NO: 64 - DNA, 22 bp, Artificial Sequence
  Synthetic oligonucleotide
gcccctatcctaccttcaatcc

SEQ ID NO: 65 - DNA, 19 bp, Artificial Sequence
  Synthetic oligonucleotide
tcctcggatgtcgctgcct

SEQ ID NO: 66 - DNA, 24 bp, Artificial Sequence
  Synthetic oligonucleotide
cctttaaccattatggccttatgc

SEQ ID NO: 67 - DNA, 23 bp, Artificial Sequence
  Synthetic oligonucleotide
caagacactaagggcgactacca

SEQ ID NO: 68 - DNA, 24 bp, Artificial Sequence
  Synthetic oligonucleotide
ccaccacacaggtacagcagcgct

SEQ ID NO: 69 - DNA, 19 bp, Artificial Sequence
  Synthetic oligonucleotide
cgtgtcgggcttcagtcat

SEQ ID NO: 70 - DNA, 20 bp, Artificial Sequence
  Synthetic oligonucleotide
gctcaagcctggaagatgac

SEQ ID NO: 71 - DNA, 24 bp, Artificial Sequence
  Synthetic oligonucleotide
agtaccctgaagtgtcccccacca

SEQ ID NO: 72 - DNA, 19 bp, Artificial Sequence
  Synthetic oligonucleotide
agaaccaccaacatccgct

SEQ ID NO: 73 - DNA, 20 bp, Artificial Sequence
  Synthetic oligonucleotide
gactgcaaagatggaaacga

SEQ ID NO: 74 - DNA, 24 bp, Artificial Sequence
  Synthetic oligonucleotide
ctatgacgatgccctcaacgcctc

SEQ ID NO: 75 - DNA, 20 bp, Artificial Sequence
  Synthetic oligonucleotide
tagccataaggtccgctctc

SEQ ID NO: 76 - DNA, 20 bp, Artificial Sequence
  Synthetic oligonucleotide
ggacagcaggaatgtgtttc

SEQ ID NO: 77 - DNA, 22 bp, Artificial Sequence
  Synthetic oligonucleotide
cattggctccccgtgacctgta

SEQ ID NO: 78 - DNA, 20 bp, Artificial Sequence
  Synthetic oligonucleotide
acccactcgatttgtttctg

SEQ ID NO: 79 - DNA, 20 bp, Artificial Sequence
  Synthetic oligonucleotide
gatgaagcctttcgcaagtt

SEQ ID NO: 80 - DNA, 21 bp, Artificial Sequence
  Synthetic oligonucleotide
ctttcgggaagccaggccctt

SEQ ID NO: 81 - DNA, 20 bp, Artificial Sequence
  Synthetic oligonucleotide
aggtctccacacagcacaag

SEQ ID NO: 82 - DNA, 19 bp, Artificial Sequence
  Synthetic oligonucleotide
accccggcctgtatatcat

SEQ ID NO: 83 - DNA, 24 bp, Artificial Sequence
  Synthetic oligonucleotide
ccaatggctcgagttcttgatccc

SEQ ID NO: 84 - DNA, 21 bp, Artificial Sequence
  Synthetic oligonucleotide
ctatctggctctttgctgcat

SEQ ID NO: 85 - DNA, 22 bp, Artificial Sequence
  Synthetic oligonucleotide
ccaccttggaccaaagtaaagc

SEQ ID NO: 86 - DNA, 22 bp, Artificial Sequence
  Synthetic oligonucleotide
ctccccaacacgctgaaacccg

SEQ ID NO: 87 - DNA, 21 bp, Artificial Sequence
  Synthetic oligonucleotide
tctcagcgtcacctggtagga

SEQ ID NO: 88 - DNA, 21 bp, Artificial Sequence
  Synthetic oligonucleotide
ggaaacacactggaggacaag

SEQ ID NO: 89 - DNA, 24 bp, Artificial Sequence
  Synthetic oligonucleotide
tcatcagccgcatcaaacagagtg

SEQ ID NO: 90 - DNA, 19 bp, Artificial Sequence
  Synthetic oligonucleotide
cgcatcttggcagaaagtt

SEQ ID NO: 91 - DNA, 27 bp, Artificial Sequence
  Synthetic oligonucleotide
tgtgagtgaaatgccttctagtagtga

SEQ ID NO: 92 - DNA, 23 bp, Artificial Sequence
  Synthetic oligonucleotide
ccgtcctcgggagccgactatga

SEQ ID NO: 93 - DNA, 27 bp, Artificial Sequence
  Synthetic oligonucleotide
ttgtggttcgttatcatactcttctga

SEQ ID NO: 94 - DNA, 21 bp, Artificial Sequence
  Synthetic oligonucleotide
cgcagtgcagctgagtatctg

SEQ ID NO: 95 - DNA, 23 bp, Artificial Sequence
  Synthetic oligonucleotide
tcgcaccaggaagctgccattga

SEQ ID NO: 96 - DNA, 21 bp, Artificial Sequence
  Synthetic oligonucleotide
tgcccagggctactctcactt

SEQ ID NO: 97 - DNA, 20 bp, Artificial Sequence
  Synthetic oligonucleotide
actggcccacttagtcctca

SEQ ID NO: 98 - DNA, 23 bp, Artificial Sequence
  Synthetic oligonucleotide
ctcccaacctgctgtccctcaag

SEQ ID NO: 99 - DNA, 20 bp, Artificial Sequence
  Synthetic oligonucleotide
ctgaactccacaggctggta

SEQ ID NO: 100 - DNA, 18 bp, Artificial Sequence
  Synthetic oligonucleotide
gcagccacctgcaacttt

SEQ ID NO: 101 - DNA, 24 bp, Artificial Sequence
  Synthetic oligonucleotide
caggcgagagagcatcccgtctac

SEQ ID NO: 102 - DNA, 18 bp, Artificial Sequence
  Synthetic oligonucleotide
tccaggagggacagctca

SEQ ID NO: 103 - DNA, 20 bp, Artificial Sequence
  Synthetic oligonucleotide
gatgctgccactcaacaact

SEQ ID NO: 104 - DNA, 24 bp, Artificial Sequence
  Synthetic oligonucleotide
agttagacgcacgccacgactcaa

SEQ ID NO: 105 - DNA, 20 bp, Artificial Sequence
  Synthetic oligonucleotide
tgtccttgcttcagcaactc

SEQ ID NO: 106 - DNA, 18 bp, Artificial Sequence
  Synthetic oligonucleotide
ccgctttcgctacagcat

SEQ ID NO: 107 - DNA, 24 bp, Artificial Sequence
  Synthetic oligonucleotide
tccagcctgtctccagtaggccac

SEQ ID NO: 108 - DNA, 21 bp, Artificial Sequence
  Synthetic oligonucleotide
tgggagtatcggatgtagctg

SEQ ID NO: 109 - DNA, 21 bp, Artificial Sequence
  Synthetic oligonucleotide
agctgcagaagagctgcacat

SEQ ID NO: 110 - DNA, 22 bp, Artificial Sequence
  Synthetic oligonucleotide
tgacgagcagcgaacagccacg

SEQ ID NO: 111 - DNA, 20 bp, Artificial Sequence
  Synthetic oligonucleotide
gcatctgccaactcctccat

SEQ ID NO: 112 - DNA, 20 bp, Artificial Sequence
  Synthetic oligonucleotide
ggctatgtctttgcaccagc

SEQ ID NO: 113 - DNA, 24 bp, Artificial Sequence
  Synthetic oligonucleotide
accagcgccaacgacagtgagata

SEQ ID NO: 114 - DNA, 18 bp, Artificial Sequence
  Synthetic oligonucleotide
atccgtcagcgcatcact

SEQ ID NO: 115 - DNA, 18 bp, Artificial Sequence
  Synthetic oligonucleotide
ccgtgtgacagcatcgtt

SEQ ID NO: 116 - DNA, 24 bp, Artificial Sequence
  Synthetic oligonucleotide
cgtactacttctgcggggaaccca

SEQ ID NO: 117 - DNA, 18 bp, Artificial Sequence
  Synthetic oligonucleotide
ctcaccagggtgcggtag

SEQ ID NO: 118 - DNA, 22 bp, Artificial Sequence
  Synthetic oligonucleotide
ggctcttgtgcgtactgtcctt

SEQ ID NO: 119 - DNA, 29 bp, Artificial Sequence
  Synthetic oligonucleotide
aggctcagtgatgtcttccctgtcaccag

SEQ ID NO: 120 - DNA, 23 bp, Artificial Sequence
  Synthetic oligonucleotide
tcagatgacgaagagcacagatg

SEQ ID NO: 121 - DNA, 19 bp, Artificial Sequence
  Synthetic oligonucleotide
gggtcaggtgcctcgagat

SEQ ID NO: 122 - DNA, 24 bp, Artificial Sequence
  Synthetic oligonucleotide
tgggcccagagcatgttccagatc

SEQ ID NO: 123 - DNA, 21 bp, Artificial Sequence
  Synthetic oligonucleotide
ctgctcactcggctcaaactc

SEQ ID NO: 124 - DNA, 23 bp, Artificial Sequence
  Synthetic oligonucleotide
cgttgtcagcacttggaatacaa

SEQ ID NO: 125 - DNA, 26 bp, Artificial Sequence
  Synthetic oligonucleotide
cccaattaacatgacccggcaaccat

SEQ ID NO: 126 - DNA, 24 bp, Artificial Sequence
  Synthetic oligonucleotide
gttcaacctcttcctgtggactgt

SEQ ID NO: 127 - DNA, 19 bp, Artificial Sequence
  Synthetic oligonucleotide
ctaggggcaaaaagcatga

SEQ ID NO: 128 - DNA, 24 bp, Artificial Sequence
  Synthetic oligonucleotide
ttccatgccagacaggaaaaagca

SEQ ID NO: 129 - DNA, 20 bp, Artificial Sequence
  Synthetic oligonucleotide
ctaaatgcccaaggtgactg

SEQ ID NO: 130 - DNA, 21 bp, Artificial Sequence
  Synthetic oligonucleotide
gaaagtaagccaggcccagtt

SEQ ID NO: 131 - DNA, 27 bp, Artificial Sequence
  Synthetic oligonucleotide
cagaactccctcctggacacatcccaa

SEQ ID NO: 132 - DNA, 21 bp, Artificial Sequence
  Synthetic oligonucleotide
acctctttgcggatcacttga

SEQ ID NO: 133 - DNA, 20 bp, Artificial Sequence
  Synthetic oligonucleotide
ccattcccaccattctacct

SEQ ID NO: 134 - DNA, 21 bp, Artificial Sequence
  Synthetic oligonucleotide
acaccccagacgtcctggcct

SEQ ID NO: 135 - DNA, 20 bp, Artificial Sequence
  Synthetic oligonucleotide
gggaacatagacccaccaat

SEQ ID NO: 136 - DNA, 18 bp, Artificial Sequence
  Synthetic oligonucleotide
ccgccgtggacacagact

SEQ ID NO: 137 - DNA, 25 bp, Artificial Sequence
  Synthetic oligonucleotide
tgccactcggaaaaagacctctcgg

SEQ ID NO: 138 - DNA, 21 bp, Artificial Sequence
  Synthetic oligonucleotide
ttgccgtcagaaaacatgtca

SEQ ID NO: 139 - DNA, 20 bp, Artificial Sequence
  Synthetic oligonucleotide
cctggagggtcctgtacaat

SEQ ID NO: 140 - DNA, 24 bp, Artificial Sequence
  Synthetic oligonucleotide
catcatgggactcctgcccttacc

SEQ ID NO: 141 - DNA, 19 bp, Artificial Sequence
  Synthetic oligonucleotide
ctaattgggctccatctcg

SEQ ID NO: 142 - DNA, 20 bp, Artificial Sequence
  Synthetic oligonucleotide
ccccgagacaacggagataa

SEQ ID NO: 143 - DNA, 23 bp, Artificial Sequence
  Synthetic oligonucleotide
ctttccgttggcatccgcaacag

SEQ ID NO: 144 - DNA, 19 bp, Artificial Sequence
  Synthetic oligonucleotide
ctcgggtttggcctctttc

SEQ ID NO: 145 - DNA, 25 bp, Artificial Sequence
  Synthetic oligonucleotide
cagatggacctagtacccactgaga

SEQ ID NO: 146 - DNA, 22 bp, Artificial Sequence
  Synthetic oligonucleotide
ttccacgccgaaggacagcgat

SEQ ID NO: 147 - DNA, 24 bp, Artificial Sequence
  Synthetic oligonucleotide
cctatgatttaagggcatttttcc

SEQ ID NO: 148 - DNA, 19 bp, Artificial Sequence
  Synthetic oligonucleotide
gctgggatggcttttgtca

SEQ ID NO: 149 - DNA, 25 bp, Artificial Sequence
  Synthetic oligonucleotide
tcttcaggaccccctttccactggc

SEQ ID NO: 150 - DNA, 21 bp, Artificial Sequence
  Synthetic oligonucleotide
gcctggaccagctgttttctc

SEQ ID NO: 151 - DNA, 20 bp, Artificial Sequence
  Synthetic oligonucleotide
aattaccaagcagccgaaga

SEQ ID NO: 152 - DNA, 28 bp, Artificial Sequence
  Synthetic oligonucleotide
ccacccacgaatggttatcttacgactg

SEQ ID NO: 153 - DNA, 20 bp, Artificial Sequence
  Synthetic oligonucleotide
caggcggacaatgtaacgta

SEQ ID NO: 154 - DNA, 18 bp, Artificial Sequence
  Synthetic oligonucleotide
aacccacccctgtcttgg

SEQ ID NO: 155 - DNA, 24 bp, Artificial Sequence
  Synthetic oligonucleotide
tccgggtagctctcaaactcgagg

SEQ ID NO: 156 - DNA, 18 bp, Artificial Sequence
  Synthetic oligonucleotide
ctcagctgacgggaaagg

SEQ ID NO: 157 - DNA, 24 bp, Artificial Sequence
  Synthetic oligonucleotide
cttttgtggaactctatgggaaca

SEQ ID NO: 158 - DNA, 20 bp, Artificial Sequence
  Synthetic oligonucleotide
ttcggctctcggctgctgca

SEQ ID NO: 159 - DNA, 19 bp, Artificial Sequence
  Synthetic oligonucleotide
cagcggttgaagcgttcct

SEQ ID NO: 160 - DNA, 26 bp, Artificial Sequence
  Synthetic oligonucleotide
tgtactggcgaagaatatttggtaaa

SEQ ID NO: 161 - DNA, 24 bp, Artificial Sequence
  Synthetic oligonucleotide
cagggcatcgatctctcaccctgg

SEQ ID NO: 162 - DNA, 20 bp, Artificial Sequence
  Synthetic oligonucleotide
gccacgtgattcttccacaa

SEQ ID NO: 163 - DNA, 24 bp, Artificial Sequence
  Synthetic oligonucleotide
ccaggaagaatgcttaagatgtga

SEQ ID NO: 164 - DNA, 26 bp, Artificial Sequence
  Synthetic oligonucleotide
ttcgccaggtcattgagatccatcca

SEQ ID NO: 165 - DNA, 24 bp, Artificial Sequence
  Synthetic oligonucleotide
tggtgatgggagttgtattttcag

SEQ ID NO: 166 - DNA, 18 bp, Artificial Sequence
  Synthetic oligonucleotide
gagctccgcaaggatgac

SEQ ID NO: 167 - DNA, 24 bp, Artificial Sequence
  Synthetic oligonucleotide
caagggtctccagcacctctacgc

SEQ ID NO: 168 - DNA, 20 bp, Artificial Sequence
  Synthetic oligonucleotide
cttgttgttcaccaggacga

SEQ ID NO: 169 - DNA, 20 bp, Artificial Sequence
  Synthetic oligonucleotide
ggactgtgaggtcaacaacg

SEQ ID NO: 170 - DNA, 24 bp, Artificial Sequence
  Synthetic oligonucleotide
tgtgatgcactcatccctgaggct

SEQ ID NO: 171 - DNA, 20 bp, Artificial Sequence
  Synthetic oligonucleotide
ggaagccaaacaccagtagg

SEQ ID NO: 172 - DNA, 23 bp, Artificial Sequence
  Synthetic oligonucleotide
attcctatggctctgcaattgtc

SEQ ID NO: 173 - DNA, 23 bp, Artificial Sequence
  Synthetic oligonucleotide
ccggttaactgtggcctgtgccc

SEQ ID NO: 174 - DNA, 21 bp, Artificial Sequence
  Synthetic oligonucleotide
ggcaggagtgaatggctcttc

SEQ ID NO: 175 - DNA, 20 bp, Artificial Sequence
  Synthetic oligonucleotide
cctgcaaaagggaacaagag

SEQ ID NO: 176 - DNA, 21 bp, Artificial Sequence
  Synthetic oligonucleotide
cttcgcctccagatggctccc

SEQ ID NO: 177 - DNA, 20 bp, Artificial Sequence
  Synthetic oligonucleotide
cgtggttgactctgatctcg

SEQ ID NO: 178 - DNA, 20 bp, Artificial Sequence
  Synthetic oligonucleotide
ggttgctgcctccatcaaag

SEQ ID NO: 179 - DNA, 27 bp, Artificial Sequence
  Synthetic oligonucleotide
acatcacagccaaaccacacagcctct

SEQ ID NO: 180 - DNA, 24 bp, Artificial Sequence
  Synthetic oligonucleotide
ccagcttgctattgaagtgttttc

SEQ ID NO: 181 - DNA, 20 bp, Artificial Sequence
  Synthetic oligonucleotide
atgtggacgctctttcaatg

SEQ ID NO: 182 - DNA, 24 bp, Artificial Sequence
  Synthetic oligonucleotide
accgcagtccgtctaagaagcacg

SEQ ID NO: 183 - DNA, 20 bp, Artificial Sequence
  Synthetic oligonucleotide
accatggtcgacctttagga

SEQ ID NO: 184 - DNA, 18 bp, Artificial Sequence
  Synthetic oligonucleotide
gggctagccattgaggtg

SEQ ID NO: 185 - DNA, 24 bp, Artificial Sequence
  Synthetic oligonucleotide
ctcacctccatcagactcggaccc

SEQ ID NO: 186 - DNA, 20 bp, Artificial Sequence
  Synthetic oligonucleotide
gctaatcctgacatgctggc

SEQ ID NO: 187 - DNA, 22 bp, Artificial Sequence
  Synthetic oligonucleotide
tcgtggaacatgacaaggaatt

SEQ ID NO: 188 - DNA, 23 bp, Artificial Sequence
  Synthetic oligonucleotide
ttccacccacgctaccaccatcg

SEQ ID NO: 189 - DNA, 22 bp, Artificial Sequence
  Synthetic oligonucleotide
tggaaagatcaaaccggaactc

SEQ ID NO: 190 - DNA, 20 bp, Artificial Sequence
  Synthetic oligonucleotide
ttggttcagcgaactattgc

SEQ ID NO: 191 - DNA, 24 bp, Artificial Sequence
  Synthetic oligonucleotide
caaacagattcagatggtccggca

SEQ ID NO: 192 - DNA, 20 bp, Artificial Sequence
  Synthetic oligonucleotide
tctccatatcggcctttacc

SEQ ID NO: 193 - DNA, 20 bp, Artificial Sequence
  Synthetic oligonucleotide
ccttccgaccagcagatgaa

SEQ ID NO: 194 - DNA, 25 bp, Artificial Sequence
  Synthetic oligonucleotide
caatttgggcaacgagaccgatcct

SEQ ID NO: 195 - DNA, 24 bp, Artificial Sequence
  Synthetic oligonucleotide
tttatatgcacattgggagctgat

SEQ ID NO: 196 - DNA, 20 bp, Artificial Sequence
  Synthetic oligonucleotide
tcagggggctagaaatctgt

SEQ ID NO: 197 - DNA, 23 bp, Artificial Sequence
  Synthetic oligonucleotide
ctatgggcccttcaccaacatgc

SEQ ID NO: 198 - DNA, 20 bp, Artificial Sequence
  Synthetic oligonucleotide
ccattccagttgatctgtgg

SEQ ID NO: 199 - DNA, 20 bp, Artificial Sequence
  Synthetic oligonucleotide
agttcgtgctttgcaagatg

SEQ ID NO: 200 - DNA, 29 bp, Artificial Sequence
  Synthetic oligonucleotide
cattcttcactgcttcataaagctctgca

SEQ ID NO: 201 - DNA, 20 bp, Artificial Sequence
  Synthetic oligonucleotide
aaggtaagctgggtctgctg

SEQ ID NO: 202 - DNA, 20 bp, Artificial Sequence
  Synthetic oligonucleotide
gtgcaggaaaggttcacaaa

SEQ ID NO: 203 - DNA, 24 bp, Artificial Sequence
  Synthetic oligonucleotide
agtgtctgcgtccaatacacgcgt

SEQ ID NO: 204 - DNA, 20 bp, Artificial Sequence
  Synthetic oligonucleotide
gcacacacgatggagtaagg

SEQ ID NO: 205 - DNA, 27 bp, Artificial Sequence
  Synthetic oligonucleotide
cagtgatccactttaacaaccctaaag

SEQ ID NO: 206 - DNA, 24 bp, Artificial Sequence
  Synthetic oligonucleotide
tcaggcatctctggcagcgaacac

SEQ ID NO: 207 - DNA, 21 bp, Artificial Sequence
  Synthetic oligonucleotide
agcatggcctgtaatggtgaa

SEQ ID NO: 208 - DNA, 20 bp, Artificial Sequence
  Synthetic oligonucleotide
gttgggacacagttggtctg

SEQ ID NO: 209 - DNA, 23 bp, Artificial Sequence
  Synthetic oligonucleotide
cagtcggcccaggacggtctact

SEQ ID NO: 210 - DNA, 20 bp, Artificial Sequence
  Synthetic oligonucleotide
tgaagcagtcagttgtgctg

SEQ ID NO: 211 - DNA, 21 bp, Artificial Sequence
  Synthetic oligonucleotide
ccgaggttaatccagcacgta

SEQ ID NO: 212 - DNA, 23 bp, Artificial Sequence
  Synthetic oligonucleotide
tgctgggagcctacacttggccc

SEQ ID NO: 213 - DNA, 21 bp, Artificial Sequence
  Synthetic oligonucleotide
aagacatggcgctctcagttc

SEQ ID NO: 214 - DNA, 24 bp, Artificial Sequence
  Synthetic oligonucleotide
tcaacagaaggctgaaccactaga

SEQ ID NO: 215 - DNA, 24 bp, Artificial Sequence
  Synthetic oligonucleotide
tacagtcccagcaccgacaattcc

SEQ ID NO: 216 - DNA, 22 bp, Artificial Sequence
  Synthetic oligonucleotide
caacagagtttgccgagacact

SEQ ID NO: 217 - DNA, 22 bp, Artificial Sequence
  Synthetic oligonucleotide
ctgaagcagatggttcatcatt

SEQ ID NO: 218 - DNA, 24 bp, Artificial Sequence
  Synthetic oligonucleotide
cctcgctttgtttaacagcccagg

SEQ ID NO: 219 - DNA, 22 bp, Artificial Sequence
  Synthetic oligonucleotide
gctgattcccaagagtctaacc

SEQ ID NO: 220 - DNA, 20 bp, Artificial Sequence
  Synthetic oligonucleotide
ccatctcgctgagatacgaa

SEQ ID NO: 221 - DNA, 28 bp, Artificial Sequence
  Synthetic oligonucleotide
gggagggtgtaccattacaggatcaaca

SEQ ID NO: 222 - DNA, 20 bp, Artificial Sequence
  Synthetic oligonucleotide
agacgtagagcttgccatca

SEQ ID NO: 223 - DNA, 25 bp, Artificial Sequence
  Synthetic oligonucleotide
gaggcaactgcttatggcttaatta

SEQ ID NO: 224 - DNA, 24 bp, Artificial Sequence
  Synthetic oligonucleotide
ttacagcgacagtcatggccgcat

SEQ ID NO: 225 - DNA, 18 bp, Artificial Sequence
  Synthetic oligonucleotide
ggcactcggcttgagcat

SEQ ID NO: 226 - DNA, 24 bp, Artificial Sequence
  Synthetic oligonucleotide
aactcagacttggaaatgccttct

SEQ ID NO: 227 - DNA, 26 bp, Artificial Sequence
  Synthetic oligonucleotide
aacttccacccccctcattggtcaca

SEQ ID NO: 228 - DNA, 27 bp, Artificial Sequence
  Synthetic oligonucleotide
ctggtctctatgaaatggtgttgtaac

SEQ ID NO: 229 - DNA, 23 bp, Artificial Sequence
  Synthetic oligonucleotide
tgaggagtggtattttggcaaga

SEQ ID NO: 230 - DNA, 24 bp, Artificial Sequence
  Synthetic oligonucleotide
aaccgctctgactcccgtctggtg

SEQ ID NO: 231 - DNA, 21 bp, Artificial Sequence
  Synthetic oligonucleotide
ctctcgggttctctgcattga

SEQ ID NO: 232 - DNA, 20 bp, Artificial Sequence
  Synthetic oligonucleotide
tcagctgtgagctgcggata

SEQ ID NO: 233 - DNA, 19 bp, Artificial Sequence
  Synthetic oligonucleotide
caggtcccattgccgggcg

SEQ ID NO: 234 - DNA, 24 bp, Artificial Sequence
  Synthetic oligonucleotide
acggtcctaggtttgaggttaaga

SEQ ID NO: 235 - DNA, 20 bp, Artificial Sequence
  Synthetic oligonucleotide
ccagcactgctcgttactgt

SEQ ID NO: 236 - DNA, 23 bp, Artificial Sequence
  Synthetic oligonucleotide
tgggacctcagaccactgaaggc

SEQ ID NO: 237 - DNA, 21 bp, Artificial Sequence
  Synthetic oligonucleotide
ttgacttcacggcagttcata

SEQ ID NO: 238 - DNA, 20 bp, Artificial Sequence
  Synthetic oligonucleotide
ctacgagtcagcccatccat

SEQ ID NO: 239 - DNA, 24 bp, Artificial Sequence
  Synthetic oligonucleotide
catggctaccacttcgacacagcc

SEQ ID NO: 240 - DNA, 18 bp, Artificial Sequence
  Synthetic oligonucleotide
tgcccacggctttcttac

SEQ ID NO: 241 - DNA, 20 bp, Artificial Sequence
  Synthetic oligonucleotide
atcctagccctggtttttgg

SEQ ID NO: 242 - DNA, 20 bp, Artificial Sequence
  Synthetic oligonucleotide
tttgctgtcaccagcgtcgc

SEQ ID NO: 243 - DNA, 20 bp, Artificial Sequence
  Synthetic oligonucleotide
ctgccttctcatctgcacaa

SEQ ID NO: 244 - DNA, 20 bp, Artificial Sequence
  Synthetic oligonucleotide
gaaggccaagaaccgagtca

SEQ ID NO: 245 - DNA, 27 bp, Artificial Sequence
  Synthetic oligonucleotide
ttatattccagtttaaggccaatcctc

SEQ ID NO: 246 - DNA, 24 bp, Artificial Sequence
  Synthetic oligonucleotide
tccccagttagttcaaaagtcaca

SEQ ID NO: 247 - DNA, 26 bp, Artificial Sequence
  Synthetic oligonucleotide
cactaaggtttgagacagttccagaa

SEQ ID NO: 248 - DNA, 26 bp, Artificial Sequence
  Synthetic oligonucleotide
aacccaagctcaagacgcaggacgag

SEQ ID NO: 249 - DNA, 23 bp, Artificial Sequence
  Synthetic oligonucleotide
gcgaattagccctctacaactga

SEQ ID NO: 250 - DNA, 20 bp, Artificial Sequence
  Synthetic oligonucleotide
gattgtcactgatggggagg

SEQ ID NO: 251 - DNA, 24 bp, Artificial Sequence
  Synthetic oligonucleotide
aggacctggatcatctcagcaggc

SEQ ID NO: 252 - DNA, 18 bp, Artificial Sequence
  Synthetic oligonucleotide
ccttcagagcaggcttgg

SEQ ID NO: 253 - DNA, 23 bp, Artificial Sequence
  Synthetic oligonucleotide
caagaagctgtacgagctcatca

SEQ ID NO: 254 - DNA, 22 bp, Artificial Sequence
  Synthetic oligonucleotide
ccgctactcggagcccgacctg

SEQ ID NO: 255 - DNA, 22 bp, Artificial Sequence
  Synthetic oligonucleotide
gcagcaaacgaaattgtcaaag

SEQ ID NO: 256 - DNA, 20 bp, Artificial Sequence
  Synthetic oligonucleotide
cctcggggatactgtctgat

SEQ ID NO: 257 - DNA, 27 bp, Artificial Sequence
  Synthetic oligonucleotide
caacaatcacaattttgcaaaagcacg

SEQ ID NO: 258 - DNA, 20 bp, Artificial Sequence
  Synthetic oligonucleotide
gaagtttgggcactttctcc

SEQ ID NO: 259 - DNA, 18 bp, Artificial Sequence
  Synthetic oligonucleotide
tgaatgccgtggattgca

SEQ ID NO: 260 - DNA, 25 bp, Artificial Sequence
  Synthetic oligonucleotide
cactagccctggaccagccactgct

SEQ ID NO: 261 - DNA, 21 bp, Artificial Sequence
  Synthetic oligonucleotide
acagggatcatgggacacaag

SEQ ID NO: 262 - DNA, 22 bp, Artificial Sequence
  Synthetic oligonucleotide
atccattcgatctcaccaaggt

SEQ ID NO: 263 - DNA, 28 bp, Artificial Sequence
  Synthetic oligonucleotide
tggcctcacaaggactaccctctcatcc

SEQ ID NO: 264 - DNA, 23 bp, Artificial Sequence
  Synthetic oligonucleotide
tccggtttaagaccagtttacca

SEQ ID NO: 265 - DNA, 20 bp, Artificial Sequence
  Synthetic oligonucleotide
gtggctcaacattgtgttcc

SEQ ID NO: 266 - DNA, 24 bp, Artificial Sequence
  Synthetic oligonucleotide
atttcagctgatcagtgggcctcc

SEQ ID NO: 267 - DNA, 20 bp, Artificial Sequence
  Synthetic oligonucleotide
caatggcctccattttacag

SEQ ID NO: 268 - DNA, 20 bp, Artificial Sequence
  Synthetic oligonucleotide
tcattcacaaacctggcagt

SEQ ID NO: 269 - DNA, 24 bp, Artificial Sequence
  Synthetic oligonucleotide
ttccggctgagctgtactcgtctg

SEQ ID NO: 270 - DNA, 20 bp, Artificial Sequence
  Synthetic oligonucleotide
catacccaatagcccactga

SEQ ID NO: 271 - DNA, 23 bp, Artificial Sequence
  Synthetic oligonucleotide
ccatgtgctgtaccaagagtttg

SEQ ID NO: 272 - DNA, 26 bp, Artificial Sequence
  Synthetic oligonucleotide
cagcactgacatcaaagcagccagga

SEQ ID NO: 273 - DNA, 18 bp, Artificial Sequence
  Synthetic oligonucleotide
cgccgcagaggtggagta

SEQ ID NO: 274 - DNA, 21 bp, Artificial Sequence
  Synthetic oligonucleotide
agcagacagtggtcagtcctt

SEQ ID NO: 275 - DNA, 24 bp, Artificial Sequence
  Synthetic oligonucleotide
ctctgctgacactcgagcccacat

SEQ ID NO: 276 - DNA, 20 bp, Artificial Sequence
  Synthetic oligonucleotide
ctgcatgattctgagcaggt

SEQ ID NO: 277 - DNA, 25 bp, Artificial Sequence
  Synthetic oligonucleotide
ccatacctcaagtatttgccatcag

SEQ ID NO: 278 - DNA, 29 bp, Artificial Sequence
  Synthetic oligonucleotide
attgctggagctgcctttcatttagcact

SEQ ID NO: 279 - DNA, 22 bp, Artificial Sequence
  Synthetic oligonucleotide
agctttgtcccgtgactgtgta

SEQ ID NO: 280 - DNA, 20 bp, Artificial Sequence
  Synthetic oligonucleotide
ttcaggttgttgcaggagac

SEQ ID NO: 281 - DNA, 27 bp, Artificial Sequence
  Synthetic oligonucleotide
tgtctccattattgatcggttcatgca

SEQ ID NO: 282 - DNA, 20 bp, Artificial Sequence
  Synthetic oligonucleotide
catcttcttgggcacacaat

SEQ ID NO: 283 - DNA, 22 bp, Artificial Sequence
  Synthetic oligonucleotide
aggcttctgcaggagactctgt

SEQ ID NO: 284 - DNA, 25 bp, Artificial Sequence
  Synthetic oligonucleotide
tcgatccataatgccaacgcacatg

SEQ ID NO: 285 - DNA, 22 bp, Artificial Sequence
  Synthetic oligonucleotide
gggaaactggctgaacctgtaa

SEQ ID NO: 286 - DNA, 21 bp, Artificial Sequence
  Synthetic oligonucleotide
gcatgttcgtggcctctaaga

SEQ ID NO: 287 - DNA, 23 bp, Artificial Sequence
  Synthetic oligonucleotide
aaggagaccatccccctgacggc

SEQ ID NO: 288 - DNA, 22 bp, Artificial Sequence
  Synthetic oligonucleotide
cggtgtagatgcacagcttctc

SEQ ID NO: 289 - DNA, 27 bp, Artificial Sequence
  Synthetic oligonucleotide
cctctgtgctacagattatacctttgc

SEQ ID NO: 290 - DNA, 22 bp, Artificial Sequence
  Synthetic oligonucleotide
tacccgccatccatgatcgcca

SEQ ID NO: 291 - DNA, 18 bp, Artificial Sequence
  Synthetic oligonucleotide
cactgcagccccaatgct

SEQ ID NO: 292 - DNA, 24 bp, Artificial Sequence
  Synthetic oligonucleotide
aaagaagatgatgaccgggtttac

SEQ ID NO: 293 - DNA, 24 bp, Artificial Sequence
  Synthetic oligonucleotide
caaactcaacgtgcaagcctcgga

SEQ ID NO: 294 - DNA, 20 bp, Artificial Sequence
  Synthetic oligonucleotide
gagcctctggatggtgcaat

SEQ ID NO: 295 - DNA, 25 bp, Artificial Sequence
  Synthetic oligonucleotide
ggtcaccaagaaacatcagtatgaa

SEQ ID NO: 296 - DNA, 30 bp, Artificial Sequence
  Synthetic oligonucleotide
cccagataatacaggtggccaacaattcct

SEQ ID NO: 297 - DNA, 25 bp, Artificial Sequence
  Synthetic oligonucleotide
ttcaatgataatgcaaggactgatc

SEQ ID NO: 298 - DNA, 22 bp, Artificial Sequence
  Synthetic oligonucleotide
atgctgtggctccttcctaact

SEQ ID NO: 299 - DNA, 30 bp, Artificial Sequence
  Synthetic oligonucleotide
taccaagcaacctacatgtcaagaaagccc

SEQ ID NO: 300 - DNA, 27 bp, Artificial Sequence
  Synthetic oligonucleotide
acccaaattgtgatatacaaaaaggtt

SEQ ID NO: 301 - DNA, 20 bp, Artificial Sequence
  Synthetic oligonucleotide
ggatgacatgcactcagctc

SEQ ID NO: 302 - DNA, 21 bp, Artificial Sequence
  Synthetic oligonucleotide
ctcccatcccagtggagccaa

SEQ ID NO: 303 - DNA, 20 bp, Artificial Sequence
  Synthetic oligonucleotide
cctgacatttcccttgtcct

SEQ ID NO: 304 - DNA, 24 bp, Artificial Sequence
  Synthetic oligonucleotide
gcaggtgtcagcaagtatgatcag

SEQ ID NO: 305 - DNA, 27 bp, Artificial Sequence
  Synthetic oligonucleotide
cgacaggatattgaccaccgcctcatt

SEQ ID NO: 306 - DNA, 20 bp, Artificial Sequence
  Synthetic oligonucleotide
tttttccgctgtggtgatga

SEQ ID NO: 307 - DNA, 18 bp, Artificial Sequence
  Synthetic oligonucleotide
gcccagtgcggagaacag

SEQ ID NO: 308 - DNA, 30 bp, Artificial Sequence
  Synthetic oligonucleotide
ccagcttgattctcgtctctgcacttaagc

SEQ ID NO: 309 - DNA, 21 bp, Artificial Sequence
  Synthetic oligonucleotide
aatcacacgcacctggagaac

SEQ ID NO: 310 - DNA, 20 bp, Artificial Sequence
  Synthetic oligonucleotide
cgtcaggacccaccatgtct

SEQ ID NO: 311 - DNA, 20 bp, Artificial Sequence
  Synthetic oligonucleotide
cgcggccgagacatggcttg

SEQ ID NO: 312 - DNA, 24 bp, Artificial Sequence
  Synthetic oligonucleotide
ggttaattggtgacatcctcaaga

SEQ ID NO: 313 - DNA, 21 bp, Artificial Sequence
  Synthetic oligonucleotide
tccaactaatgccaccaccaa

SEQ ID NO: 314 - DNA, 23 bp, Artificial Sequence
  Synthetic oligonucleotide
ctgttgactgcagggcaccacca

SEQ ID NO: 315 - DNA, 25 bp, Artificial Sequence
  Synthetic oligonucleotide
gagagagtgagaccacgaagagact

SEQ ID NO: 316 - DNA, 21 bp, Artificial Sequence
  Synthetic oligonucleotide
tgtgaaagggaaacacctttg

SEQ ID NO: 317 - DNA, 24 bp, Artificial Sequence
  Synthetic oligonucleotide
ccaagtcccctatttcccggacct

SEQ ID NO: 318 - DNA, 19 bp, Artificial Sequence
  Synthetic oligonucleotide
agcacccaaaagggcttag

SEQ ID NO: 319 - DNA, 25 bp, Artificial Sequence
  Synthetic oligonucleotide
tgtatttcaagacctctgtgcactt

SEQ ID NO: 320 - DNA, 25 bp, Artificial Sequence
  Synthetic oligonucleotide
tttatgaacctgccctgctcccaca

SEQ ID NO: 321 - DNA, 23 bp, Artificial Sequence
  Synthetic oligonucleotide
ttagcctgaggaattgctgtgtt

SEQ ID NO: 322 - DNA, 19 bp, Artificial Sequence
  Synthetic oligonucleotide
ccactgcacacacctcaga

SEQ ID NO: 323 - DNA, 24 bp, Artificial Sequence
  Synthetic oligonucleotide
ctgttcttggggccctacaccttg

SEQ ID NO: 324 - DNA, 19 bp, Artificial Sequence
  Synthetic oligonucleotide
caggagtttacctgcccct

SEQ ID NO: 325 - DNA, 20 bp, Artificial Sequence
  Synthetic oligonucleotide
agatgaagtggaaggcgctt

SEQ ID NO: 326 - DNA, 18 bp, Artificial Sequence
  Synthetic oligonucleotide
caccgcggccatcctgca

SEQ ID NO: 327 - DNA, 21 bp, Artificial Sequence
  Synthetic oligonucleotide
tgcctctgtaatcggcaactg

SEQ ID NO: 328 - DNA, 19 bp, Artificial Sequence
  Synthetic oligonucleotide
atcaccgacagcacagaca

SEQ ID NO: 329 - DNA, 27 bp, Artificial Sequence
  Synthetic oligonucleotide
ccctgctaccaatatggactccagtca

SEQ ID NO: 330 - DNA, 20 bp, Artificial Sequence
  Synthetic oligonucleotide
acctgtgtttggatttgcag

SEQ ID NO: 331 - DNA, 20 bp, Artificial Sequence
  Synthetic oligonucleotide
gacgaagacagtccctggat

SEQ ID NO: 332 - DNA, 24 bp, Artificial Sequence
  Synthetic oligonucleotide
caccgacagcacagacagaatccc

SEQ ID NO: 333 - DNA, 20 bp, Artificial Sequence
  Synthetic oligonucleotide
actggggtggaatgtgtctt

SEQ ID NO: 334 - DNA, 22 bp, Artificial Sequence
  Synthetic oligonucleotide
cacacaaaacagaaccaggact

SEQ ID NO: 335 - DNA, 23 bp, Artificial Sequence
  Synthetic oligonucleotide
acccagtggaacccaagccattc

SEQ ID NO: 336 - DNA, 21 bp, Artificial Sequence
  Synthetic oligonucleotide
ctgaagtagcacttccggatt

SEQ ID NO: 337 - DNA, 20 bp, Artificial Sequence
  Synthetic oligonucleotide
ctcataccagccatccaatg

SEQ ID NO: 338 - DNA, 24 bp, Artificial Sequence
  Synthetic oligonucleotide
caccaagcccagaggacagttcct

SEQ ID NO: 339 - DNA, 21 bp, Artificial Sequence
  Synthetic oligonucleotide
ttgggttgaagaaatcagtcc

SEQ ID NO: 340 - DNA, 18 bp, Artificial Sequence
  Synthetic oligonucleotide
tggttcccagccctgtgt

SEQ ID NO: 341 - DNA, 28 bp, Artificial Sequence
  Synthetic oligonucleotide
ctccaagcccagattcagattcgagtca

SEQ ID NO: 342 - DNA, 19 bp, Artificial Sequence
  Synthetic oligonucleotide
ctcctccaccctgggttgt

SEQ ID NO: 343 - DNA, 20 bp, Artificial Sequence
  Synthetic oligonucleotide
ttcagttgctttgcaggaag

SEQ ID NO: 344 - DNA, 28 bp, Artificial Sequence
  Synthetic oligonucleotide
ttctgtgcccaccatattcctctagaca

SEQ ID NO: 345 - DNA, 20 bp, Artificial Sequence
  Synthetic oligonucleotide
ttgatcaaggtcaccagagc

SEQ ID NO: 346 - DNA, 20 bp, Artificial Sequence
  Synthetic oligonucleotide
gtgcaggctcaggtgaagtg

SEQ ID NO: 347 - DNA, 30 bp, Artificial Sequence
  Synthetic oligonucleotide
tcagcttctacaactggacagacaacgctg

SEQ ID NO: 348 - DNA, 20 bp, Artificial Sequence
  Synthetic oligonucleotide
gacctcagggcgattcatga

SEQ ID NO: 349 - DNA, 20 bp, Artificial Sequence
  Synthetic oligonucleotide
agggtgaggtgcttgagtct

SEQ ID NO: 350 - DNA, 26 bp, Artificial Sequence
  Synthetic oligonucleotide
ccaacggcaagggaacaagtacttct

SEQ ID NO: 351 - DNA, 19 bp, Artificial Sequence
  Synthetic oligonucleotide
gggcacagtatcccaggta

SEQ ID NO: 352 - DNA, 20 bp, Artificial Sequence
  Synthetic oligonucleotide
gggcgtggaacagtttatct

SEQ ID NO: 353 - DNA, 24 bp, Artificial Sequence
  Synthetic oligonucleotide
agacatctgccccaagaaggacgt

SEQ ID NO: 354 - DNA, 19 bp, Artificial Sequence
  Synthetic oligonucleotide
cacggtgaaggtttcgagt

SEQ ID NO: 355 - DNA, 18 bp, Artificial Sequence
  Synthetic oligonucleotide
gagagcgacgcggttgtt

SEQ ID NO: 356 - DNA, 18 bp, Artificial Sequence
  Synthetic oligonucleotide
tagctgccgctgcggccg

SEQ ID NO: 357 - DNA, 26 bp, Artificial Sequence
  Synthetic oligonucleotide
gtatggtagatcccggcttattattc

SEQ ID NO: 358 - DNA, 21 bp, Artificial Sequence
  Synthetic oligonucleotide
tggattggagttctgggaatg

SEQ ID NO: 359 - DNA, 23 bp, Artificial Sequence
  Synthetic oligonucleotide
actggccgtggcactggacaaca

SEQ ID NO: 360 - DNA, 22 bp, Artificial Sequence
  Synthetic oligonucleotide
gcttgcactccacaggtacaca

SEQ ID NO: 361 - DNA, 20 bp, Artificial Sequence
  Synthetic oligonucleotide
tcttgctggctacgcctctt

SEQ ID NO: 362 - DNA, 28 bp, Artificial Sequence
  Synthetic oligonucleotide
tgtccctgttagacgtcctccgtccata

SEQ ID NO: 363 - DNA, 21 bp, Artificial Sequence
  Synthetic oligonucleotide
ctgcattgtggcacagttctg

SEQ ID NO: 364 - DNA, 21 bp, Artificial Sequence
  Synthetic oligonucleotide
aaacgagcagtttgccatcag

SEQ ID NO: 365 - DNA, 24 bp, Artificial Sequence
  Synthetic oligonucleotide
cctcaccggcatagactggaagcg

SEQ ID NO: 366 - DNA, 20 bp, Artificial Sequence
  Synthetic oligonucleotide
gttggtgatgttccgaagca

SEQ ID NO: 367 - DNA, 20 bp, Artificial Sequence
  Synthetic oligonucleotide
ggtgagcagaagtggcctat

SEQ ID NO: 368 - DNA, 23 bp, Artificial Sequence
  Synthetic oligonucleotide
ctccccgtcgatgccagagaact

SEQ ID NO: 369 - DNA, 20 bp, Artificial Sequence
  Synthetic oligonucleotide
cttcagtcttggcctgttca

SEQ ID NO: 370 - DNA, 18 bp, Artificial Sequence
  Synthetic oligonucleotide
gcagtccgctgtgttcaa

SEQ ID NO: 371 - DNA, 24 bp, Artificial Sequence
  Synthetic oligonucleotide
tgctccactaacaaccctcctgcc

SEQ ID NO: 372 - DNA, 22 bp, Artificial Sequence
  Synthetic oligonucleotide
ggatcccacacctttaccataa

SEQ ID NO: 373 - DNA, 18 bp, Artificial Sequence
  Synthetic oligonucleotide
tccagagactgctgaaaa

SEQ ID NO: 374 - DNA, 23 bp, Artificial Sequence
  Synthetic oligonucleotide
cccgtgacctgaaggctgtcaag

SEQ ID NO: 375 - DNA, 18 bp, Artificial Sequence
  Synthetic oligonucleotide
tgtgtaagtgcagaacac

SEQ ID NO: 376 - DNA, 20 bp, Artificial Sequence
  Synthetic oligonucleotide
gagctgaaagacgcacactg

SEQ ID NO: 377 - DNA, 24 bp, Artificial Sequence
  Synthetic oligonucleotide
aattcctgcatggccagtttcctc

SEQ ID NO: 378 - DNA, 18 bp, Artificial Sequence
  Synthetic oligonucleotide
gccgctcattgatctcca

SEQ ID NO: 379 - DNA, 21 bp, Artificial Sequence
  Synthetic oligonucleotide
gcaacactccccatttacctc

SEQ ID NO: 380 - DNA, 24 bp, Artificial Sequence
  Synthetic oligonucleotide
ttgttctccaccaaagcaaggcaa

SEQ ID NO: 381 - DNA, 20 bp, Artificial Sequence
  Synthetic oligonucleotide
tgagggggaccattctcttt

SEQ ID NO: 382 - DNA, 20 bp, Artificial Sequence
  Synthetic oligonucleotide
aagaccgtggatggctacat

SEQ ID NO: 383 - DNA, 24 bp, Artificial Sequence
  Synthetic oligonucleotide
atgaagatgacctgcccagaagcc

SEQ ID NO: 384 - DNA, 19 bp, Artificial Sequence
  Synthetic oligonucleotide
agggtcacggatgatctgg

SEQ ID NO: 385 - DNA, 21 bp, Artificial Sequence
  Synthetic oligonucleotide
tgagtgtcccccggtatcttc

SEQ ID NO: 386 - DNA, 27 bp, Artificial Sequence
  Synthetic oligonucleotide
tgccaatcccgatgaaattggaaattt

SEQ ID NO: 387 - DNA, 21 bp, Artificial Sequence
  Synthetic oligonucleotide
cagccgctttcagattttcat

SEQ ID NO: 388 - DNA, 18 bp, Artificial Sequence
  Synthetic oligonucleotide
gtcggcagaagcaggact

SEQ ID NO: 389 - DNA, 24 bp, Artificial Sequence
  Synthetic oligonucleotide
ccttctgcccatagtgatcagcga

SEQ ID NO: 390 - DNA, 18 bp, Artificial Sequence
  Synthetic oligonucleotide
ctactcatgggcgggatg

SEQ ID NO: 391 - DNA, 18 bp, Artificial Sequence
  Synthetic oligonucleotide
acccatgtaccgtcctcg

SEQ ID NO: 392 - DNA, 24 bp, Artificial Sequence
  Synthetic oligonucleotide
ccaacccagatgaaatcggcaact

SEQ ID NO: 393 - DNA, 19 bp, Artificial Sequence
  Synthetic oligonucleotide
ccgccttcaggttctcaat

SEQ ID NO: 394 - DNA, 20 bp, Artificial Sequence
  Synthetic oligonucleotide
aatgctgcactacgacccta

SEQ ID NO: 395 - DNA, 21 bp, Artificial Sequence
  Synthetic oligonucleotide
ccttggccgaaatccgcttgt

SEQ ID NO: 396 - DNA, 20 bp, Artificial Sequence
  Synthetic oligonucleotide
ttggtcacatcctggaagaa

SEQ ID NO: 397 - DNA, 18 bp, Artificial Sequence
  Synthetic oligonucleotide
agcaacaccagcctcctg

SEQ ID NO: 398 - DNA, 24 bp, Artificial Sequence
  Synthetic oligonucleotide
cacctcctctccaatgcctgtgaa

SEQ ID NO: 399 - DNA, 20 bp, Artificial Sequence
  Synthetic oligonucleotide
gggctatggcagaaactcct

SEQ ID NO: 400 - DNA, 18 bp, Artificial Sequence
  Synthetic oligonucleotide
gggcaggcaaggtttaca

SEQ ID NO: 401 - DNA, 24 bp, Artificial Sequence
  Synthetic oligonucleotide
atcttagctgcctttggcttccgc

SEQ ID NO: 402 - DNA, 22 bp, Artificial Sequence
  Synthetic oligonucleotide
gtctttggtcagtccagctttc

SEQ ID NO: 403 - DNA, 22 bp, Artificial Sequence
  Synthetic oligonucleotide
acttgcctgttcagagcactca

SEQ ID NO: 404 - DNA, 23 bp, Artificial Sequence
  Synthetic oligonucleotide
tccttcccacccccagtcctgtc

SEQ ID NO: 405 - DNA, 22 bp, Artificial Sequence
  Synthetic oligonucleotide
tggcaaatccgaattagagtga

SEQ ID NO: 406 - DNA, 24 bp, Artificial Sequence
  Synthetic oligonucleotide
cacagcctcacttctaaccttctg

SEQ ID NO: 407 - DNA, 23 bp, Artificial Sequence
  Synthetic oligonucleotide
acccacccaccactgccaagctc

SEQ ID NO: 408 - DNA, 22 bp, Artificial Sequence
  Synthetic oligonucleotide
ttgaatggcgtggattcaatag

SEQ ID NO: 409 - DNA, 20 bp, Artificial Sequence
  Synthetic oligonucleotide
gcaacccacgtgtaactgtc

SEQ ID NO: 410 - DNA, 23 bp, Artificial Sequence
  Synthetic oligonucleotide
ccgggccctgagtaatcgcttaa

SEQ ID NO: 411 - DNA, 20 bp, Artificial Sequence
  Synthetic oligonucleotide
acaagcccgtaggaacatct

SEQ ID NO: 412 - DNA, 21 bp, Artificial Sequence
  Synthetic oligonucleotide
tgacaatcagcacacctgcat

SEQ ID NO: 413 - DNA, 20 bp, Artificial Sequence
  Synthetic oligonucleotide
caggccctcttccgagcggt

SEQ ID NO: 414 - DNA, 23 bp, Artificial Sequence
  Synthetic oligonucleotide
tgtgactacagccgtgatcctta

SEQ ID NO: 415 - DNA, 21 bp, Artificial Sequence
  Synthetic oligonucleotide
taaattcactcgtggtgtgga

SEQ ID NO: 416 - DNA, 21 bp, Artificial Sequence
  Synthetic oligonucleotide
cttcaattggcaagcccaggc

SEQ ID NO: 417 - DNA, 20 bp, Artificial Sequence
  Synthetic oligonucleotide
gcctcttgtagggccaatag

SEQ ID NO: 418 - DNA, 20 bp, Artificial Sequence
  Synthetic oligonucleotide
ggatgctggtgacctcttct

SEQ ID NO: 419 - DNA, 25 bp, Artificial Sequence
  Synthetic oligonucleotide
tccctcacgttgcaacaggaattaa

SEQ ID NO: 420 - DNA, 20 bp, Artificial Sequence
  Synthetic oligonucleotide
gccaaggcaccaagtaactc

SEQ ID NO: 421 - DNA, 18 bp, Artificial Sequence
  Synthetic oligonucleotide
ctcccgtcaacagcgttc

SEQ ID NO: 422 - DNA, 24 bp, Artificial Sequence
  Synthetic oligonucleotide
acactggaccaggagtgcatccag

SEQ ID NO: 423 - DNA, 18 bp, Artificial Sequence
  Synthetic oligonucleotide
gggtgagtctggccttca

SEQ ID NO: 424 - DNA, 20 bp, Artificial Sequence
  Synthetic oligonucleotide
actttgcgagaaatgggaac

SEQ ID NO: 425 - DNA, 22 bp, Artificial Sequence
  Synthetic oligonucleotide
agtgtggcagaccctcgccatt

SEQ ID NO: 426 - DNA, 20 bp, Artificial Sequence
  Synthetic oligonucleotide
caggtattgctcctcctggt

SEQ ID NO: 427 - DNA, 20 bp, Artificial Sequence
  Synthetic oligonucleotide
ctgaaggagctccaagacct

SEQ ID NO: 428 - DNA, 22 bp, Artificial Sequence
  Synthetic oligonucleotide
tgctgatgtgccctctccttgg

SEQ ID NO: 429 - DNA, 20 bp, Artificial Sequence
  Synthetic oligonucleotide
caaaaccgctgtgtttcttc

SEQ ID NO: 430 - DNA, 18 bp, Artificial Sequence
  Synthetic oligonucleotide
ccaccataggcagaggca

SEQ ID NO: 431 - DNA, 24 bp, Artificial Sequence
  Synthetic oligonucleotide
acaccctactccctgtgcctccag

SEQ ID NO: 432 - DNA, 20 bp, Artificial Sequence
  Synthetic oligonucleotide
agtcgtcgagtgctagggac

SEQ ID NO: 433 - DNA, 20 bp, Artificial Sequence
  Synthetic oligonucleotide
gaggccagtggtggaaacag

SEQ ID NO: 434 - DNA, 26 bp, Artificial Sequence
  Synthetic oligonucleotide
agctgatgagtctgccctaccgcctg

SEQ ID NO: 435 - DNA, 18 bp, Artificial Sequence
  Synthetic oligonucleotide
tccgaggccacagcaaac

SEQ ID NO: 436 - DNA, 18 bp, Artificial Sequence
  Synthetic oligonucleotide
ctctgtgcgaggctgtca

SEQ ID NO: 437 - DNA, 24 bp, Artificial Sequence
  Synthetic oligonucleotide
acccatctcgggatccctgatacc

SEQ ID NO: 438 - DNA, 19 bp, Artificial Sequence
  Synthetic oligonucleotide
ggtaaggactgtgggctgg

SEQ ID NO: 439 - DNA, 20 bp, Artificial Sequence
  Synthetic oligonucleotide
aaggaagtggtccctctgtg

SEQ ID NO: 440 - DNA, 24 bp, Artificial Sequence
  Synthetic oligonucleotide
tgaagtctccagctttgcctcagc

SEQ ID NO: 441 - DNA, 20 bp, Artificial Sequence
  Synthetic oligonucleotide
gacgcagtctttctgtctgg

SEQ ID NO: 442 - DNA, 26 bp, Artificial Sequence
  Synthetic oligonucleotide
gataaattggtacaagggatcagctt

SEQ ID NO: 443 - DNA, 26 bp, Artificial Sequence
  Synthetic oligonucleotide
ccagcccacatgtcctgatcatatgc

SEQ ID NO: 444 - DNA, 24 bp, Artificial Sequence
  Synthetic oligonucleotide
gggtgccaagtaactgactattca

SEQ ID NO: 445 - DNA, 21 bp, Artificial Sequence
  Synthetic oligonucleotide
atgtggaacccccacctactt

SEQ ID NO: 446 - DNA, 29 bp, Artificial Sequence
  Synthetic oligonucleotide
agtcccaacagaaacaagaacttcaggcg

SEQ ID NO: 447 - DNA, 22 bp, Artificial Sequence
  Synthetic oligonucleotide
cagtccacagcacggttatacc

SEQ ID NO: 448 - DNA, 18 bp, Artificial Sequence
  Synthetic oligonucleotide
tgcctgtggtgggaagct

SEQ ID NO: 449 - DNA, 30 bp, Artificial Sequence
  Synthetic oligonucleotide
tgacatagcatcatcctttggttcccagtt

SEQ ID NO: 450 - DNA, 19 bp, Artificial Sequence
  Synthetic oligonucleotide
ggaaaatgcctccggtgtt

SEQ ID NO: 451 - DNA, 24 bp, Artificial Sequence
  Synthetic oligonucleotide
ggatatttccgtggctcttattca

SEQ ID NO: 452 - DNA, 30 bp, Artificial Sequence
  Synthetic oligonucleotide
tctccatcaaatcctgtaaactccagagca

SEQ ID NO: 453 - DNA, 25 bp, Artificial Sequence
  Synthetic oligonucleotide
cttctcatcaaggcagaaaaatctt

SEQ ID NO: 454 - DNA, 20 bp, Artificial Sequence
  Synthetic oligonucleotide
ggtccctaaaacccatctga

SEQ ID NO: 455 - DNA, 24 bp, Artificial Sequence
  Synthetic oligonucleotide
tgaacgccaagattcctccattca

SEQ ID NO: 456 - DNA, 20 bp, Artificial Sequence
  Synthetic oligonucleotide
taatggacccatccctgact

SEQ ID NO: 457 - DNA, 20 bp, Artificial Sequence
  Synthetic oligonucleotide
ggctggacgtggttttgtct

SEQ ID NO: 458 - DNA, 18 bp, Artificial Sequence
  Synthetic oligonucleotide
ctgcgcccgctcttcgcg

SEQ ID NO: 459 - DNA, 20 bp, Artificial Sequence
  Synthetic oligonucleotide
cgctgcagaaaatgaaacga

SEQ ID NO: 460 - DNA, 19 bp, Artificial Sequence
  Synthetic oligonucleotide
ggctgctttgctgcaactg

SEQ ID NO: 461 - DNA, 24 bp, Artificial Sequence
  Synthetic oligonucleotide
cgcacagacaagccttactccgcc

SEQ ID NO: 462 - DNA, 19 bp, Artificial Sequence
  Synthetic oligonucleotide
cagagcgggcagcagaata

SEQ ID NO: 463 - DNA, 19 bp, Artificial Sequence
  Synthetic oligonucleotide
tctgggaggtgccctactt

SEQ ID NO: 464 - DNA, 24 bp, Artificial Sequence
  Synthetic oligonucleotide
tgttcctgtccccgaaaaacaacc

SEQ ID NO: 465 - DNA, 19 bp, Artificial Sequence
  Synthetic oligonucleotide
tggatagggccttggtgtt

SEQ ID NO: 466 - DNA, 20 bp, Artificial Sequence
  Synthetic oligonucleotide
ggtctgccctagtcatcctg

SEQ ID NO: 467 - DNA, 24 bp, Artificial Sequence
  Synthetic oligonucleotide
tgcactgctctcctgttcctgtcc

SEQ ID NO: 468 - DNA, 20 bp, Artificial Sequence
  Synthetic oligonucleotide
gtacccagccttgctctcat

SEQ ID NO: 469 - DNA, 20 bp, Artificial Sequence
  Synthetic oligonucleotide
cggtacttgagcaatgccta

SEQ ID NO: 470 - DNA, 23 bp, Artificial Sequence
  Synthetic oligonucleotide
cgggaagaattcgcttccacctg

SEQ ID NO: 471 - DNA, 20 bp, Artificial Sequence
  Synthetic oligonucleotide
tcgatctcctcatcatctgg

SEQ ID NO: 472 - DNA, 19 bp, Artificial Sequence
  Synthetic oligonucleotide
accgtatggacagccacag

SEQ ID NO: 473 - DNA, 24 bp, Artificial Sequence
  Synthetic oligonucleotide
tctcacatgctgtacccaaagcca

SEQ ID NO: 474 - DNA, 21 bp, Artificial Sequence
  Synthetic oligonucleotide
tgactacaggatcagcgcttc

SEQ ID NO: 475 - DNA, 23 bp, Artificial Sequence
  Synthetic oligonucleotide
ccccaggatacctaccactacct

SEQ ID NO: 476 - DNA, 20 bp, Artificial Sequence
  Synthetic oligonucleotide
cccttcagcctgccccaccg

SEQ ID NO: 477 - DNA, 18 bp, Artificial Sequence
  Synthetic oligonucleotide
tgcgggacttgggaaaga

SEQ ID NO: 478 - DNA, 22 bp, Artificial Sequence
  Synthetic oligonucleotide
gacatttccagtcctgcagtca

SEQ ID NO: 479 - DNA, 23 bp, Artificial Sequence
  Synthetic oligonucleotide
tgcctctctgccccaccctttgt

SEQ ID NO: 480 - DNA, 20 bp, Artificial Sequence
  Synthetic oligonucleotide
ctccgatcgcacacatttgt

SEQ ID NO: 481 - DNA, 21 bp, Artificial Sequence
  Synthetic oligonucleotide
tccctccactcggaaggacta

SEQ ID NO: 482 - DNA, 27 bp, Artificial Sequence
  Synthetic oligonucleotide
tctgacactgtccaacttgaccctctt

SEQ ID NO: 483 - DNA, 22 bp, Artificial Sequence
  Synthetic oligonucleotide
cggttgttgctgatctgtctca

SEQ ID NO: 484 - DNA, 18 bp, Artificial Sequence
  Synthetic oligonucleotide
tccaccctcctggctttg

SEQ ID NO: 485 - DNA, 23 bp, Artificial Sequence
  Synthetic oligonucleotide
tcctttcgtcttcgccatgctgg

SEQ ID NO: 486 - DNA, 21 bp, Artificial Sequence
  Synthetic oligonucleotide
tcactcccacgttcaccttgt

SEQ ID NO: 487 - DNA, 18 bp, Artificial Sequence
  Synthetic oligonucleotide
gtggccatccagctgacc

SEQ ID NO: 488 - DNA, 21 bp, Artificial Sequence
  Synthetic oligonucleotide
tcctgcgcctgatgtccaccg

SEQ ID NO: 489 - DNA, 23 bp, Artificial Sequence
  Synthetic oligonucleotide
cagtggtaggtgatgttctggga

SEQ ID NO: 490 - DNA, 24 bp, Artificial Sequence
  Synthetic oligonucleotide
cagccaagaactggtataggagct

SEQ ID NO: 491 - DNA, 30 bp, Artificial Sequence
  Synthetic oligonucleotide
tctcctagccagacgtgtttcttgtccttg

SEQ ID NO: 492 - DNA, 19 bp, Artificial Sequence
  Synthetic oligonucleotide
aaactggctgccagcattg

SEQ ID NO: 493 - DNA, 20 bp, Artificial Sequence
  Synthetic oligonucleotide
atgcccagtgttcctgactt

SEQ ID NO: 494 - DNA, 26 bp, Artificial Sequence
  Synthetic oligonucleotide
cgaaacgctattctcacaggttcagc

SEQ ID NO: 495 - DNA, 20 bp, Artificial Sequence
  Synthetic oligonucleotide
ctccccattacaagtgctga

SEQ ID NO: 496 - DNA, 23 bp, Artificial Sequence
  Synthetic oligonucleotide
tctgcagagttggaagcactcta

SEQ ID NO: 497 - DNA, 28 bp, Artificial Sequence
  Synthetic oligonucleotide
caggatacagctccacagcatcgatgtc

SEQ ID NO: 498 - DNA, 21 bp, Artificial Sequence
  Synthetic oligonucleotide
gccgaggcttttctaccagaa

SEQ ID NO: 499 - DNA, 20 bp, Artificial Sequence
  Synthetic oligonucleotide
tcgagtctcccttcaccatt

SEQ ID NO: 500 - DNA, 23 bp, Artificial Sequence
  Synthetic oligonucleotide
cgacggcatctacggctcaacat

SEQ ID NO: 501 - DNA, 19 bp, Artificial Sequence
  Synthetic oligonucleotide
gacgtgaagtccgtggaag

SEQ ID NO: 502 - DNA, 21 bp, Artificial Sequence
  Synthetic oligonucleotide
cgtgagtacacagatgcctcc

SEQ ID NO: 503 - DNA, 24 bp, Artificial Sequence
  Synthetic oligonucleotide
tcttcagggcctctctcctttcga

SEQ ID NO: 504 - DNA, 18 bp, Artificial Sequence
  Synthetic oligonucleotide
ccaggatgccaagatgct

SEQ ID NO: 505 - DNA, 23 bp, Artificial Sequence
  Synthetic oligonucleotide
tggtctgcaagcaagtattcaag

SEQ ID NO: 506 - DNA, 23 bp, Artificial Sequence
  Synthetic oligonucleotide
tctgcttgggcctcactgcacct

SEQ ID NO: 507 - DNA, 21 bp, Artificial Sequence
  Synthetic oligonucleotide
gctgattggttgggacaaggt

SEQ ID NO: 508 - DNA, 21 bp, Artificial Sequence
  Synthetic oligonucleotide
tgggaagcagctgtgtaccat

SEQ ID NO: 509 - DNA, 28 bp, Artificial Sequence
  Synthetic oligonucleotide
cctcgcgatgctgcctactacagctatc

SEQ ID NO: 510 - DNA, 30 bp, Artificial Sequence
  Synthetic oligonucleotide
gaaacacttctcacagaaatgatacctatt

SEQ ID NO: 511 - DNA, 18 bp, Artificial Sequence
  Synthetic oligonucleotide
gtgctacgccaccctgtt

SEQ ID NO: 512 - DNA, 22 bp, Artificial Sequence
  Synthetic oligonucleotide
ccgatgttcacgcctttgggtc

SEQ ID NO: 513 - DNA, 20 bp, Artificial Sequence
  Synthetic oligonucleotide
caggggcttctcgtagatgt

SEQ ID NO: 514 - DNA, 18 bp, Artificial Sequence
  Synthetic oligonucleotide
gggtctgtgccccatgac

SEQ ID NO: 515 - DNA, 25 bp, Artificial Sequence
  Synthetic oligonucleotide
cctggctgcccaagaagtgttccct

SEQ ID NO: 516 - DNA, 20 bp, Artificial Sequence
  Synthetic oligonucleotide
tgaccgtgccagcatttaca

SEQ ID NO: 517 - DNA, 20 bp, Artificial Sequence
  Synthetic oligonucleotide
ctccctaacctccagaatgg

SEQ ID NO: 518 - DNA, 24 bp, Artificial Sequence
  Synthetic oligonucleotide
actcgcttctggataaccctggca

SEQ ID NO: 519 - DNA, 20 bp, Artificial Sequence
  Synthetic oligonucleotide
tgtcttgtcgtaggcattgg

SEQ ID NO: 520 - DNA, 20 bp, Artificial Sequence
  Synthetic oligonucleotide
aaggtttttggattgcaagg

SEQ ID NO: 521 - DNA, 24 bp, Artificial Sequence
  Synthetic oligonucleotide
accgtcatacatgcccctggaaac

SEQ ID NO: 522 - DNA, 20 bp, Artificial Sequence
  Synthetic oligonucleotide
gggtgtagctggtacctcgt

SEQ ID NO: 523 - DNA, 20 bp, Artificial Sequence
  Synthetic oligonucleotide
gatgtgattgaggtgcatgg

SEQ ID NO: 524 - DNA, 24 bp, Artificial Sequence
  Synthetic oligonucleotide
tgttcatcctggcgctcttcatgt

SEQ ID NO: 525 - DNA, 21 bp, Artificial Sequence
  Synthetic oligonucleotide
gaactccctggagatgaaacc

SEQ ID NO: 526 - DNA, 20 bp, Artificial Sequence
  Synthetic oligonucleotide
ttacgcagctcatgctcttg

SEQ ID NO: 527 - DNA, 24 bp, Artificial Sequence
  Synthetic oligonucleotide
acggctctttactatgcgagggcc

SEQ ID NO: 528 - DNA, 22 bp, Artificial Sequence
  Synthetic oligonucleotide
gcagctgtaaagagagtggcat

SEQ ID NO: 529 - DNA, 18 bp, Artificial Sequence
  Synthetic oligonucleotide
tgcagcggctgattgaca

SEQ ID NO: 530 - DNA, 28 bp, Artificial Sequence
  Synthetic oligonucleotide
tcagatggagacctcgtgccaaattaca

SEQ ID NO: 531 - DNA, 25 bp, Artificial Sequence
  Synthetic oligonucleotide
caactgttcctggtctacaaactca

SEQ ID NO: 532 - DNA, 20 bp, Artificial Sequence
  Synthetic oligonucleotide
cctgaacatgaaggagctga

SEQ ID NO: 533 - DNA, 21 bp, Artificial Sequence
  Synthetic oligonucleotide
tcccgatggtctgcagcagct

SEQ ID NO: 534 - DNA, 19 bp, Artificial Sequence
  Synthetic oligonucleotide
catcacgtctccgaactcc

SEQ ID NO: 535 - DNA, 20 bp, Artificial Sequence
  Synthetic oligonucleotide
gctctccatcagctcctgtc

SEQ ID NO: 536 - DNA, 24 bp, Artificial Sequence
  Synthetic oligonucleotide
ccacatcaacagggaaagctgctg

SEQ ID NO: 537 - DNA, 19 bp, Artificial Sequence
  Synthetic oligonucleotide
aacacgggcagaaagcact

SEQ ID NO: 538 - DNA, 19 bp, Artificial Sequence
  Synthetic oligonucleotide
gagttcaagtgccctgacg

SEQ ID NO: 539 - DNA, 28 bp, Artificial Sequence
  Synthetic oligonucleotide
aacatcatgttcttcttcatgacctcgc

SEQ ID NO: 540 - DNA, 20 bp, Artificial Sequence
  Synthetic oligonucleotide
agttgtaatggcaggcacag

SEQ ID NO: 541 - DNA, 20 bp, Artificial Sequence
  Synthetic oligonucleotide
gctcacttcggctaaaatgc

SEQ ID NO: 542 - DNA, 24 bp, Artificial Sequence
  Synthetic oligonucleotide
accaacgctgacagcatgcatttc

SEQ ID NO: 543 - DNA, 21 bp, Artificial Sequence
  Synthetic oligonucleotide
tcagctccattgaatgtgaaa

SEQ ID NO: 544 - DNA, 19 bp, Artificial Sequence
  Synthetic oligonucleotide
cactgaggtccgggtgaca

SEQ ID NO: 545 - DNA, 21 bp, Artificial Sequence
  Synthetic oligonucleotide
cacctggctgtcagcctgccg

SEQ ID NO: 546 - DNA, 21 bp, Artificial Sequence
  Synthetic oligonucleotide
gtaggttgccgcacagacttc

SEQ ID NO: 547 - DNA, 19 bp, Artificial Sequence
  Synthetic oligonucleotide
gttttccaggtcggagacg

SEQ ID NO: 548 - DNA, 24 bp, Artificial Sequence
  Synthetic oligonucleotide
ctttgcagctactgcctccggtct

SEQ ID NO: 549 - DNA, 18 bp, Artificial Sequence
  Synthetic oligonucleotide
agcatccagggtgttcca

SEQ ID NO: 550 - DNA, 20 bp, Artificial Sequence
  Synthetic oligonucleotide
ggccgagatctacaaaaacg

SEQ ID NO: 551 - DNA, 21 bp, Artificial Sequence
  Synthetic oligonucleotide
ccccgtggagggagctttctc

SEQ ID NO: 552 - DNA, 20 bp, Artificial Sequence
  Synthetic oligonucleotide
gcaggaagtccgaatacaca

SEQ ID NO: 553 - DNA, 24 bp, Artificial Sequence
  Synthetic oligonucleotide
gtacatgatcccctgtgagaaggt

SEQ ID NO: 554 - DNA, 22 bp, Artificial Sequence
  Synthetic oligonucleotide
accctgcccgcgatcacactga

SEQ ID NO: 555 - DNA, 21 bp, Artificial Sequence
  Synthetic oligonucleotide
gggacagcttgtagcctttgc

SEQ ID NO: 556 - DNA, 20 bp, Artificial Sequence
  Synthetic oligonucleotide
gcaagttccaacctggaaag

SEQ ID NO: 557 - DNA, 24 bp, Artificial Sequence
  Synthetic oligonucleotide
tggctacatccttgacaaagccga

SEQ ID NO: 558 - DNA, 20 bp, Artificial Sequence
  Synthetic oligonucleotide
catcgcttcctcgtcataga

SEQ ID NO: 559 - DNA, 23 bp, Artificial Sequence
  Synthetic oligonucleotide
gggaggcttatctcactgagtga

SEQ ID NO: 560 - DNA, 29 bp, Artificial Sequence
  Synthetic oligonucleotide
ttgaggcccagagcagtctaccagattct

SEQ ID NO: 561 - DNA, 19 bp, Artificial Sequence
  Synthetic oligonucleotide
ccattgcagccttcattgc

SEQ ID NO: 562 - DNA, 21 bp, Artificial Sequence
  Synthetic oligonucleotide
tgtctcactgagcgagcagaa

SEQ ID NO: 563 - DNA, 24 bp, Artificial Sequence
  Synthetic oligonucleotide
cttgaggacgcgaacagtccacca

SEQ ID NO: 564 - DNA, 19 bp, Artificial Sequence
  Synthetic oligonucleotide
accattgcagccctgattg

SEQ ID NO: 565 - DNA, 21 bp, Artificial Sequence
  Synthetic oligonucleotide
atgccctggtaatgtctgcat

SEQ ID NO: 566 - DNA, 24 bp, Artificial Sequence
  Synthetic oligonucleotide
cagccacaaagccagcgtcattgt

SEQ ID NO: 567 - DNA, 21 bp, Artificial Sequence
  Synthetic oligonucleotide
gcgaccacaagccttatcaag

SEQ ID NO: 568 - DNA, 21 bp, Artificial Sequence
  Synthetic oligonucleotide
aagcatcttcctgttcttgga

SEQ ID NO: 569 - DNA, 24 bp, Artificial Sequence
  Synthetic oligonucleotide
tatgtgctgcagaactccacgctg

SEQ ID NO: 570 - DNA, 20 bp, Artificial Sequence
  Synthetic oligonucleotide
aatcccatatcccagatgga

SEQ ID NO: 571 - DNA, 19 bp, Artificial Sequence
  Synthetic oligonucleotide
gagctacagatgcccatgc

SEQ ID NO: 572 - DNA, 24 bp, Artificial Sequence
  Synthetic oligonucleotide
ttcttcgaaagccatgttgccaga

SEQ ID NO: 573 - DNA, 20 bp, Artificial Sequence
  Synthetic oligonucleotide
tttgagatgcttgacgttgg

SEQ ID NO: 574 - DNA, 20 bp, Artificial Sequence
  Synthetic oligonucleotide
tgaccgcttctaccccaatg

SEQ ID NO: 575 - DNA, 28 bp, Artificial Sequence
  Synthetic oligonucleotide
ctgaaactggaacacaaccacccacaag

SEQ ID NO: 576 - DNA, 22 bp, Artificial Sequence
  Synthetic oligonucleotide
aggataaggccaaccatgatgt

SEQ ID NO: 577 - DNA, 19 bp, Artificial Sequence
  Synthetic oligonucleotide
ggtgcctactccattgtgg

SEQ ID NO: 578 - DNA, 24 bp, Artificial Sequence
  Synthetic oligonucleotide
tactccagcaggcacacaaacacg

SEQ ID NO: 579 - DNA, 20 bp, Artificial Sequence
  Synthetic oligonucleotide
gtggagcccttcttcctctt

SEQ ID NO: 580 - DNA, 22 bp, Artificial Sequence
  Synthetic oligonucleotide
ccagctttgtgcctgtcactat

SEQ ID NO: 581 - DNA, 25 bp, Artificial Sequence
  Synthetic oligonucleotide
ctcatgccaccactgccaacacctc

SEQ ID NO: 582 - DNA, 20 bp, Artificial Sequence
  Synthetic oligonucleotide
gggaatgtggtagcccaaga

SEQ ID NO: 583 - DNA, 20 bp, Artificial Sequence
  Synthetic oligonucleotide
ccgtgttcaagaggaagctc

SEQ ID NO: 584 - DNA, 24 bp, Artificial Sequence
  Synthetic oligonucleotide
ttttctcaactcctccacaaggca

SEQ ID NO: 585 - DNA, 20 bp, Artificial Sequence
  Synthetic oligonucleotide
agtgggatcacagggtgaag

SEQ ID NO: 586 - DNA, 30 bp, Artificial Sequence
  Synthetic oligonucleotide
agaacaaggacaacatagatccttacatat

SEQ ID NO: 587 - DNA, 26 bp, Artificial Sequence
  Synthetic oligonucleotide
cacaccctttggaagtggacccagaa

SEQ ID NO: 588 - DNA, 19 bp, Artificial Sequence
  Synthetic oligonucleotide
gcaaacctcatgccaatgc

SEQ ID NO: 589 - DNA, 20 bp, Artificial Sequence
  Synthetic oligonucleotide
tgctcattcttgaggagcat

SEQ ID NO: 590 - DNA, 24 bp, Artificial Sequence
  Synthetic oligonucleotide
cagcacccttggcagtttcgaaat

SEQ ID NO: 591 - DNA, 20 bp, Artificial Sequence
  Synthetic oligonucleotide
gtggctgcattagtgtccat

SEQ ID NO: 592 - DNA, 22 bp, Artificial Sequence
  Synthetic oligonucleotide
cgctgacatcatgaatgttcct

SEQ ID NO: 593 - DNA, 25 bp, Artificial Sequence
  Synthetic oligonucleotide
tcatatccaaactcgcctccagccg

SEQ ID NO: 594 - DNA, 24 bp, Artificial Sequence
  Synthetic oligonucleotide
tctctttcagcaacgatgtgtctt

SEQ ID NO: 595 - DNA, 20 bp, Artificial Sequence
  Synthetic oligonucleotide
aaatgtcctcctcgactgct

SEQ ID NO: 596 - DNA, 24 bp, Artificial Sequence
  Synthetic oligonucleotide
atcactggaactcctcggtcggac

SEQ ID NO: 597 - DNA, 20 bp, Artificial Sequence
  Synthetic oligonucleotide
tgaatgccatctttcttcca

SEQ ID NO: 598 - DNA, 20 bp, Artificial Sequence
  Synthetic oligonucleotide
ggtcaccgttggtgtcatca

SEQ ID NO: 599 - DNA, 26 bp, Artificial Sequence
  Synthetic oligonucleotide
cagccacgatgaccactaccagcact

SEQ ID NO: 600 - DNA, 18 bp, Artificial Sequence
  Synthetic oligonucleotide
gagcgtcgggtgcaaatc

SEQ ID NO: 601 - DNA, 24 bp, Artificial Sequence
  Synthetic oligonucleotide
atggagatgtggtcattcctagtg

SEQ ID NO: 602 - DNA, 26 bp, Artificial Sequence
  Synthetic oligonucleotide
tgcttcctcccactatctgaaaataa

SEQ ID NO: 603 - DNA, 22 bp, Artificial Sequence
  Synthetic oligonucleotide
caccaccccaagtatccgtaag

SEQ ID NO: 604 - DNA, 21 bp, Artificial Sequence
  Synthetic oligonucleotide
gccgccacaagactaaggaat

SEQ ID NO: 605 - DNA, 24 bp, Artificial Sequence
  Synthetic oligonucleotide
agctgcccgtctttctcagccagc

SEQ ID NO: 606 - DNA, 20 bp, Artificial Sequence
  Synthetic oligonucleotide
cgatgttcccttcgatggag

SEQ ID NO: 607 - DNA, 18 bp, Artificial Sequence
  Synthetic oligonucleotide
tgcggatcatccggaatg

SEQ ID NO: 608 - DNA, 25 bp, Artificial Sequence
  Synthetic oligonucleotide
aattggaatccacgagcatgccagc

SEQ ID NO: 609 - DNA, 22 bp, Artificial Sequence
  Synthetic oligonucleotide
tcctttgatgcctggtaagtca

SEQ ID NO: 610 - DNA, 22 bp, Artificial Sequence
  Synthetic oligonucleotide
cttgtggagatcacccaatcag

SEQ ID NO: 611 - DNA, 21 bp, Artificial Sequence
  Synthetic oligonucleotide
ctatgcccgggactcgggcct

SEQ ID NO: 612 - DNA, 19 bp, Artificial Sequence
  Synthetic oligonucleotide
cccgcctggatctcaaact

SEQ ID NO: 613 - DNA, 27 bp, Artificial Sequence
  Synthetic oligonucleotide
ttgctataactaagtgcttctccaaga

SEQ ID NO: 614 - DNA, 22 bp, Artificial Sequence
  Synthetic oligonucleotide
cccaactgagtccccagcacct

SEQ ID NO: 615 - DNA, 22 bp, Artificial Sequence
  Synthetic oligonucleotide
gtggaatggcagctcactgtag

SEQ ID NO: 616 - DNA, 22 bp, Artificial Sequence
  Synthetic oligonucleotide
gggagaacgggatcaataggat

SEQ ID NO: 617 - DNA, 24 bp, Artificial Sequence
  Synthetic oligonucleotide
ctcattgggcaccagcaggtttcc

SEQ ID NO: 618 - DNA, 21 bp, Artificial Sequence
  Synthetic oligonucleotide
gcatcagccagtcctcaaact

SEQ ID NO: 619 - DNA, 19 bp, Artificial Sequence
  Synthetic oligonucleotide
cacaatggcggctctgaag

SEQ ID NO: 620 - DNA, 23 bp, Artificial Sequence
  Synthetic oligonucleotide
aagttacgctgcgcgacagccaa

SEQ ID NO: 621 - DNA, 26 bp, Artificial Sequence
  Synthetic oligonucleotide
acacaaacactgtctgtacctgaaga

SEQ ID NO: 622 - DNA, 20 bp, Artificial Sequence
  Synthetic oligonucleotide
caagcagtcaaggagaacca

SEQ ID NO: 623 - DNA, 22 bp, Artificial Sequence
  Synthetic oligonucleotide
ttcttctgtctcccgccgcttc

SEQ ID NO: 624 - DNA, 20 bp, Artificial Sequence
  Synthetic oligonucleotide
agttttgctcgcctcatctt

SEQ ID NO: 625 - DNA, 20 bp, Artificial Sequence
  Synthetic oligonucleotide
tccaattccagcatcactgt

SEQ ID NO: 626 - DNA, 25 bp, Artificial Sequence
  Synthetic oligonucleotide
agaaaagctgtttgtctccccagca

SEQ ID NO: 627 - DNA, 20 bp, Artificial Sequence
  Synthetic oligonucleotide
ggcagtgaaggcgataaagt

SEQ ID NO: 628 - DNA, 20 bp, Artificial Sequence
  Synthetic oligonucleotide
tgacaactaccagccgtacc

SEQ ID NO: 629 - DNA, 22 bp, Artificial Sequence
  Synthetic oligonucleotide
agtgccgcactcctcgtcctct

SEQ ID NO: 630 - DNA, 21 bp, Artificial Sequence
  Synthetic oligonucleotide
gggactagcgcagtactcatc

SEQ ID NO: 631 - DNA, 20 bp, Artificial Sequence
  Synthetic oligonucleotide
gattcagacgaggatgagcc

SEQ ID NO: 632 - DNA, 24 bp, Artificial Sequence
  Synthetic oligonucleotide
aaagtccatttgccactgatggca

SEQ ID NO: 633 - DNA, 20 bp, Artificial Sequence
  Synthetic oligonucleotide
cacctcttgctgtccctttg

SEQ ID NO: 634 - DNA, 19 bp, Artificial Sequence
  Synthetic oligonucleotide
aggacgcaaggagggtttg

SEQ ID NO: 635 - DNA, 29 bp, Artificial Sequence
  Synthetic oligonucleotide
cagtgcctacagtctcgagtctgccagtg

SEQ ID NO: 636 - DNA, 21 bp, Artificial Sequence
  Synthetic oligonucleotide
gatgtccgccgagtccttact

SEQ ID NO: 637 - DNA, 21 bp, Artificial Sequence
  Synthetic oligonucleotide
tgcacagagggtgtgggttac

SEQ ID NO: 638 - DNA, 29 bp, Artificial Sequence
  Synthetic oligonucleotide
caatgcttccaacaatttgtttgcttgcc

SEQ ID NO: 639 - DNA, 28 bp, Artificial Sequence
  Synthetic oligonucleotide
tcttcatctgatttacaagctgtacatg

SEQ ID NO: 640 - DNA, 24 bp, Artificial Sequence
  Synthetic oligonucleotide
ctctgagacagtgcttcgatgact

SEQ ID NO: 641 - DNA, 23 bp, Artificial Sequence
  Synthetic oligonucleotide
cagacttggtgccctttgactcc

SEQ ID NO: 642 - DNA, 19 bp, Artificial Sequence
  Synthetic oligonucleotide
ccatgaggcccaacttcct

SEQ ID NO: 643 - DNA, 20 bp, Artificial Sequence
  Synthetic oligonucleotide
cctggatctcccaggtatca

SEQ ID NO: 644 - DNA, 24 bp, Artificial Sequence
  Synthetic oligonucleotide
acctttcccatccttggcaccttc

SEQ ID NO: 645 - DNA, 20 bp, Artificial Sequence
  Synthetic oligonucleotide
tgcaatgacttgacgacctc

SEQ ID NO: 646 - DNA, 22 bp, Artificial Sequence
  Synthetic oligonucleotide
tggcactactgcatgattgaca

SEQ ID NO: 647 - DNA, 21 bp, Artificial Sequence
  Synthetic oligonucleotide
cagggccatgacaatcgccaa

SEQ ID NO: 648 - DNA, 19 bp, Artificial Sequence
  Synthetic oligonucleotide
cctgccgcattgttttcag

SEQ ID NO: 649 - DNA, 19 bp, Artificial Sequence
  Synthetic oligonucleotide
aaatcgctgggaacaagtg

SEQ ID NO: 650 - DNA, 24 bp, Artificial Sequence
  Synthetic oligonucleotide
cgccctggctcaacttttccttaa

SEQ ID NO: 651 - DNA, 20 bp, Artificial Sequence
  Synthetic oligonucleotide
aatgcgtatctgtccacgac

SEQ ID NO: 652 - DNA, 20 bp, Artificial Sequence
  Synthetic oligonucleotide
agacatcagctcctggttca

SEQ ID NO: 653 - DNA, 26 bp, Artificial Sequence
  Synthetic oligonucleotide
cgaggccattgacttcatagactcca

SEQ ID NO: 654 - DNA, 20 bp, Artificial Sequence
  Synthetic oligonucleotide
gacaaacacccttcctccag

SEQ ID NO: 655 - DNA, 20 bp, Artificial Sequence
  Synthetic oligonucleotide
tatccctgtggaggacaacc

SEQ ID NO: 656 - DNA, 24 bp, Artificial Sequence
  Synthetic oligonucleotide
cctcctggaaccaggcactgatct

SEQ ID NO: 657 - DNA, 20 bp, Artificial Sequence
  Synthetic oligonucleotide
cacccagtcaatgaagccta

SEQ ID NO: 658 - DNA, 20 bp, Artificial Sequence
  Synthetic oligonucleotide
acacatggagtgcttctgga

SEQ ID NO: 659 - DNA, 24 bp, Artificial Sequence
  Synthetic oligonucleotide
atcagcccacttgaccacccagtt

SEQ ID NO: 660 - DNA, 19 bp, Artificial Sequence
  Synthetic oligonucleotide
ctcttgcctgtgcttccac

SEQ ID NO: 661 - DNA, 20 bp, Artificial Sequence
  Synthetic oligonucleotide
agcatgacacggagatgaag

SEQ ID NO: 662 - DNA, 24 bp, Artificial Sequence
  Synthetic oligonucleotide
cacctgaagcggcacttcatgttc

SEQ ID NO: 663 - DNA, 20 bp, Artificial Sequence
  Synthetic oligonucleotide
aataccaggcacaggtggtt

SEQ ID NO: 664 - DNA, 20 bp, Artificial Sequence
  Synthetic oligonucleotide
actccctctacccttgagca

SEQ ID NO: 665 - DNA, 24 bp, Artificial Sequence
  Synthetic oligonucleotide
cagaagaacagctcagggacccct

SEQ ID NO: 666 - DNA, 20 bp, Artificial Sequence
  Synthetic oligonucleotide
caggcctcagttccttcagt

SEQ ID NO: 667 - DNA, 20 bp, Artificial Sequence
  Synthetic oligonucleotide
tgccacctggacatcatttg

SEQ ID NO: 668 - DNA, 23 bp, Artificial Sequence
  Synthetic oligonucleotide
cactcccgagcacgttgttccgt

SEQ ID NO: 669 - DNA, 21 bp, Artificial Sequence
  Synthetic oligonucleotide
tggacctagggcttccaagtc

SEQ ID NO: 670 - DNA, 20 bp, Artificial Sequence
  Synthetic oligonucleotide
tacatctccaaacccatcca

SEQ ID NO: 671 - DNA, 24 bp, Artificial Sequence
  Synthetic oligonucleotide
caacctcaagcagcggtcttcatg

SEQ ID NO: 672 - DNA, 20 bp, Artificial Sequence
  Synthetic oligonucleotide
ttgccactgacagtcacctt

SEQ ID NO: 673 - DNA, 20 bp, Artificial Sequence
  Synthetic oligonucleotide
actacatctccacgcccact

SEQ ID NO: 674 - DNA, 25 bp, Artificial Sequence
  Synthetic oligonucleotide
cctcagacacttccagtgcaggttg

SEQ ID NO: 675 - DNA, 20 bp, Artificial Sequence
  Synthetic oligonucleotide
cagcagacgaacaccttcat

SEQ ID NO: 676 - DNA, 18 bp, Artificial Sequence
  Synthetic oligonucleotide
ggagcccgtatcctggag

SEQ ID NO: 677 - DNA, 24 bp, Artificial Sequence
  Synthetic oligonucleotide
ccctcaaccccaagttcctgagtg

SEQ ID NO: 678 - DNA, 21 bp, Artificial Sequence
  Synthetic oligonucleotide
ggatagatcaccaagcccttc

SEQ ID NO: 679 - DNA, 23 bp, Artificial Sequence
  Synthetic oligonucleotide
tgacattatcatcccgctaagga

SEQ ID NO: 680 - DNA, 24 bp, Artificial Sequence
  Synthetic oligonucleotide
cggacagcgtcttctgccctcact

SEQ ID NO: 681 - DNA, 21 bp, Artificial Sequence
  Synthetic oligonucleotide
gtagtccccgctgaccttctc

SEQ ID NO: 682 - DNA, 20 bp, Artificial Sequence
  Synthetic oligonucleotide
ttgaacagagcctgaccaag

SEQ ID NO: 683 - DNA, 28 bp, Artificial Sequence
  Synthetic oligonucleotide
tgatgctttctccagaaactcgaactca

SEQ ID NO: 684 - DNA, 20 bp, Artificial Sequence
  Synthetic oligonucleotide
tgttgagattcctcgcagtt

SEQ ID NO: 685 - DNA, 20 bp, Artificial Sequence
  Synthetic oligonucleotide
tgtcgatggacttccagaac

SEQ ID NO: 686 - DNA, 18 bp, Artificial Sequence
  Synthetic oligonucleotide
cacctgggcagctgccaa

SEQ ID NO: 687 - DNA, 19 bp, Artificial Sequence
  Synthetic oligonucleotide
attgggacagcttggatca

SEQ ID NO: 688 - DNA, 18 bp, Artificial Sequence
  Synthetic oligonucleotide
tcaatggccggacgaaag

SEQ ID NO: 689 - DNA, 26 bp, Artificial Sequence
  Synthetic oligonucleotide
cattgcccggataacaagcaaccatg

SEQ ID NO: 690 - DNA, 28 bp, Artificial Sequence
  Synthetic oligonucleotide
tttggattatcaacatgacgtacataac

SEQ ID NO: 691 - DNA, 18 bp, Artificial Sequence
  Synthetic oligonucleotide
gctggtcctctactgcgg

SEQ ID NO: 692 - DNA, 24 bp, Artificial Sequence
  Synthetic oligonucleotide
ccggctgggcaaatactacgtcaa

SEQ ID NO: 693 - DNA, 20 bp, Artificial Sequence
  Synthetic oligonucleotide
ccaccattgccttagacctc

SEQ ID NO: 694 - DNA, 19 bp, Artificial Sequence
  Synthetic oligonucleotide
gtccccgctgcagatctct

SEQ ID NO: 695 - DNA, 23 bp, Artificial Sequence
  Synthetic oligonucleotide
cggatcctttcctcactcgccca

SEQ ID NO: 696 - DNA, 24 bp, Artificial Sequence
  Synthetic oligonucleotide
ctccagcttagggtagttgtccat

SEQ ID NO: 697 - DNA, 20 bp, Artificial Sequence
  Synthetic oligonucleotide
ccatgtggatgaatgaggtg

SEQ ID NO: 698 - DNA, 24 bp, Artificial Sequence
  Synthetic oligonucleotide
acccagtctcaccttctccccacc

SEQ ID NO: 699 - DNA, 20 bp, Artificial Sequence
  Synthetic oligonucleotide
tgcctgagaagaggtgaggt

SEQ ID NO: 700 - DNA, 20 bp, Artificial Sequence
  Synthetic oligonucleotide
aaagtggtgaatgccatttg

SEQ ID NO: 701 - DNA, 28 bp, Artificial Sequence
  Synthetic oligonucleotide
cctcaaatgccaggtcagctatatcctg

SEQ ID NO: 702 - DNA, 20 bp, Artificial Sequence
  Synthetic oligonucleotide
gtgaggcttcctccctgata

SEQ ID NO: 703 - DNA, 23 bp, Artificial Sequence
  Synthetic oligonucleotide
gatctaagatggcgactgtcgaa

SEQ ID NO: 704 - DNA, 27 bp, Artificial Sequence
  Synthetic oligonucleotide
accacccctactcctaatcccccgact

SEQ ID NO: 705 - DNA, 25 bp, Artificial Sequence
  Synthetic oligonucleotide
ttagattccgttttctcctcttctg

SEQ ID NO: 706 - DNA, 18 bp, Artificial Sequence
  Synthetic oligonucleotide
aagccgcggttgaatgtg

SEQ ID NO: 707 - DNA, 25 bp, Artificial Sequence
  Synthetic oligonucleotide
tgaccctctccctctctggatggca

SEQ ID NO: 708 - DNA, 20 bp, Artificial Sequence
  Synthetic oligonucleotide
tgacgccagcttcaatgatg

SEQ ID NO: 709 - DNA, 20 bp, Artificial Sequence
  Synthetic oligonucleotide
gacaggaggcctctatcctg

SEQ ID NO: 710 - DNA, 22 bp, Artificial Sequence
  Synthetic oligonucleotide
caccccaccctccacctcaatc

SEQ ID NO: 711 - DNA, 20 bp, Artificial Sequence
  Synthetic oligonucleotide
gtgaggtaggtctggggaag

SEQ ID NO: 712 - DNA, 25 bp, Artificial Sequence
  Synthetic oligonucleotide
gctagtactttgatgctcccttgat

SEQ ID NO: 713 - DNA, 22 bp, Artificial Sequence
  Synthetic oligonucleotide
ccagagagcctccctgcagcca

SEQ ID NO: 714 - DNA, 20 bp, Artificial Sequence
  Synthetic oligonucleotide
gaacagctggaggccaagtc

SEQ ID NO: 715 - DNA, 20 bp, Artificial Sequence
  Synthetic oligonucleotide
tggcctacctcttcaccatc

SEQ ID NO: 716 - DNA, 24 bp, Artificial Sequence
  Synthetic oligonucleotide
tcaacagcctccaaggcttcttca

SEQ ID NO: 717 - DNA, 21 bp, Artificial Sequence
  Synthetic oligonucleotide
tgaggaggcagtagaccaaga

SEQ ID NO: 718 - DNA, 22 bp, Artificial Sequence
  Synthetic oligonucleotide
ggcagtgtcactgagtccttga

SEQ ID NO: 719 - DNA, 18 bp, Artificial Sequence
  Synthetic oligonucleotide
atcctcccctgccccgcg

SEQ ID NO: 720 - DNA, 18 bp, Artificial Sequence
  Synthetic oligonucleotide
tgcactgtgcgtcccaat

SEQ ID NO: 721 - DNA, 20 bp, Artificial Sequence
  Synthetic oligonucleotide
caaggccgtgaacgagaagt

SEQ ID NO: 722 - DNA, 26 bp, Artificial Sequence
  Synthetic oligonucleotide
ctgcaactgcctcctgctcaaagtca

SEQ ID NO: 723 - DNA, 18 bp, Artificial Sequence
  Synthetic oligonucleotide
cggtcacggagccaatct

SEQ ID NO: 724 - DNA, 20 bp, Artificial Sequence
  Synthetic oligonucleotide
agccccagcaactacagtct

SEQ ID NO: 725 - DNA, 23 bp, Artificial Sequence
  Synthetic oligonucleotide
cactgacatcatggctggccttg

SEQ ID NO: 726 - DNA, 20 bp, Artificial Sequence
  Synthetic oligonucleotide
tgttcaaaggttgaccatgc

SEQ ID NO: 727 - DNA, 21 bp, Artificial Sequence
  Synthetic oligonucleotide
aagccttggagggtttcattg

SEQ ID NO: 728 - DNA, 23 bp, Artificial Sequence
  Synthetic oligonucleotide
tgtcgccatcttgggtcaccacg

SEQ ID NO: 729 - DNA, 25 bp, Artificial Sequence
  Synthetic oligonucleotide
tgctgatgttttctgacagaaagat

SEQ ID NO: 730 - DNA, 20 bp, Artificial Sequence
  Synthetic oligonucleotide
gggccctccagaacaatgat

SEQ ID NO: 731 - DNA, 25 bp, Artificial Sequence
  Synthetic oligonucleotide
ccgctctcatcgcagtcaggatcat

SEQ ID NO: 732 - DNA, 21 bp, Artificial Sequence
  Synthetic oligonucleotide
tgcactgcttggccttaaaga

SEQ ID NO: 733 - DNA, 21 bp, Artificial Sequence
  Synthetic oligonucleotide
cgcctgttcaccaagattgac

SEQ ID NO: 734 - DNA, 20 bp, Artificial Sequence
  Synthetic oligonucleotide
tgcgcccgatgagatcaccg

SEQ ID NO: 735 - DNA, 18 bp, Artificial Sequence
  Synthetic oligonucleotide
gtggcgtgcctcgaagtc

SEQ ID NO: 736 - DNA, 18 bp, Artificial Sequence
  Synthetic oligonucleotide
caaccaggcagctccatc

SEQ ID NO: 737 - DNA, 24 bp, Artificial Sequence
  Synthetic oligonucleotide
cacctgatgcatgatggacactgc

SEQ ID NO: 738 - DNA, 19 bp, Artificial Sequence
  Synthetic oligonucleotide
gtaatgctgtccacggtgc

SEQ ID NO: 739 - DNA, 20 bp, Artificial Sequence
  Synthetic oligonucleotide
tgaacggggtatcctcctta

SEQ ID NO: 740 - DNA, 24 bp, Artificial Sequence
  Synthetic oligonucleotide
cgtcccatttgagcctgtcaatgt

SEQ ID NO: 741 - DNA, 20 bp, Artificial Sequence
  Synthetic oligonucleotide
aggtacctctcggtcagtgg

SEQ ID NO: 742 - DNA, 18 bp, Artificial Sequence
  Synthetic oligonucleotide
actggtcctccatcggct

SEQ ID NO: 743 - DNA, 24 bp, Artificial Sequence
  Synthetic oligonucleotide
ccttgcacctcaaaccaaagctcc

SEQ ID NO: 744 - DNA, 21 bp, Artificial Sequence
  Synthetic oligonucleotide
ccagtgtagcatgagtgctga

SEQ ID NO: 745 - DNA, 20 bp, Artificial Sequence
  Synthetic oligonucleotide
actgtggcacttaggggaga

SEQ ID NO: 746 - DNA, 24 bp, Artificial Sequence
  Synthetic oligonucleotide
ctgcctctgcccaaagcaaatgtc

SEQ ID NO: 747 - DNA, 20 bp, Artificial Sequence
  Synthetic oligonucleotide
agtggaaatgtgtcctggct

SEQ ID NO: 748 - DNA, 23 bp, Artificial Sequence
  Synthetic oligonucleotide
cggttatgtcatgccagatacac

SEQ ID NO: 749 - DNA, 25 bp, Artificial Sequence
  Synthetic oligonucleotide
cctcaaaggtactccctcctcccgg

SEQ ID NO: 750 - DNA, 24 bp, Artificial Sequence
  Synthetic oligonucleotide
gaactgagacccactgaagaaagg

SEQ ID NO: 751 - DNA, 20 bp, Artificial Sequence
  Synthetic oligonucleotide
gtccaggtggatgtgaaaga

SEQ ID NO: 752 - DNA, 21 bp, Artificial Sequence
  Synthetic oligonucleotide
cagcaggccctcaaggagctg

SEQ ID NO: 753 - DNA, 20 bp, Artificial Sequence
  Synthetic oligonucleotide
cggccaggatacacatctta

SEQ ID NO: 754 - DNA, 19 bp, Artificial Sequence
  Synthetic oligonucleotide
tggccttcttcaccagcta

SEQ ID NO: 755 - DNA, 24 bp, Artificial Sequence
  Synthetic oligonucleotide
aggccacggtgctctccatgtact

SEQ ID NO: 756 - DNA, 20 bp, Artificial Sequence
  Synthetic oligonucleotide
caaggatcccctgctcatac

SEQ ID NO: 757 - DNA, 28 bp, Artificial Sequence
  Synthetic oligonucleotide
ataacaaagtgtagctctgacatgaatg

SEQ ID NO: 758 - DNA, 30 bp, Artificial Sequence
  Synthetic oligonucleotide
ttgtttgcatggacagtgcatctatctggt

SEQ ID NO: 759 - DNA, 24 bp, Artificial Sequence
  Synthetic oligonucleotide
cacacctgcagtagttttgactca

SEQ ID NO: 760 - DNA, 20 bp, Artificial Sequence
  Synthetic oligonucleotide
acggatcacagtggaggaag

SEQ ID NO: 761 - DNA, 20 bp, Artificial Sequence
  Synthetic oligonucleotide
cgctggctcacccctacctg

SEQ ID NO: 762 - DNA, 20 bp, Artificial Sequence
  Synthetic oligonucleotide
ctcatccgtcgggtcatagt

SEQ ID NO: 763 - DNA, 20 bp, Artificial Sequence
  Synthetic oligonucleotide
agttcttgacccctggtcct

SEQ ID NO: 764 - DNA, 20 bp, Artificial Sequence
  Synthetic oligonucleotide
tctccagcccgtcttggctt

SEQ ID NO: 765 - DNA, 20 bp, Artificial Sequence
  Synthetic oligonucleotide
aaacggctcaaaggagtcaa

SEQ ID NO: 766 - DNA, 18 bp, Artificial Sequence
  Synthetic oligonucleotide
acccccagaccggatcag

SEQ ID NO: 767 - DNA, 23 bp, Artificial Sequence
  Synthetic oligonucleotide
ctggccctcatgtccccttcacg

SEQ ID NO: 768 - DNA, 23 bp, Artificial Sequence
  Synthetic oligonucleotide
tgtagggcagacttcctcaaaca

SEQ ID NO: 769 - DNA, 19 bp, Artificial Sequence
  Synthetic oligonucleotide
cgtggtgcccctctatgac

SEQ ID NO: 770 - DNA, 19 bp, Artificial Sequence
  Synthetic oligonucleotide
ctggagatgctggacgccc

SEQ ID NO: 771 - DNA, 19 bp, Artificial Sequence
  Synthetic oligonucleotide
ggctagtgggcgcatgtag

SEQ ID NO: 772 - DNA, 18 bp, Artificial Sequence
  Synthetic oligonucleotide
tccagtgcctatgacccc

SEQ ID NO: 773 - DNA, 24 bp, Artificial Sequence
  Synthetic oligonucleotide
cagacaaatcgccatcaagtcccc

SEQ ID NO: 774 - DNA, 18 bp, Artificial Sequence
  Synthetic oligonucleotide
actgtccaagggcaccag

SEQ ID NO: 775 - DNA, 23 bp, Artificial Sequence
  Synthetic oligonucleotide
gtgaaggatgtgaagcagacgta

SEQ ID NO: 776 - DNA, 21 bp, Artificial Sequence
  Synthetic oligonucleotide
tggcacgggtcttctcctacc

SEQ ID NO: 777 - DNA, 20 bp, Artificial Sequence
  Synthetic oligonucleotide
aaccggtgctctccacattc

SEQ ID NO: 778 - DNA, 19 bp, Artificial Sequence
  Synthetic oligonucleotide
gctttgccaccaggaaagt

SEQ ID NO: 779 - DNA, 24 bp, Artificial Sequence
  Synthetic oligonucleotide
ctggcatggccaaacctaacatga

SEQ ID NO: 780 - DNA, 20 bp, Artificial Sequence
  Synthetic oligonucleotide
catccccattcacactgatg

SEQ ID NO: 781 - DNA, 18 bp, Artificial Sequence
  Synthetic oligonucleotide
ctgaccagaaccacggct

SEQ ID NO: 782 - DNA, 24 bp, Artificial Sequence
  Synthetic oligonucleotide
cggcctgtccacgaaccacttata

SEQ ID NO: 783 - DNA, 18 bp, Artificial Sequence
  Synthetic oligonucleotide
ggaagtgggtcatgtggg

SEQ ID NO: 784 - DNA, 21 bp, Artificial Sequence
  Synthetic oligonucleotide
ggattgctcaacaaccatgct

SEQ ID NO: 785 - DNA, 30 bp, Artificial Sequence
  Synthetic oligonucleotide
tctggaccctcctacctctggttcttacgt

SEQ ID NO: 786 - DNA, 24 bp, Artificial Sequence
  Synthetic oligonucleotide
ggcattaacacttttggacgataa

SEQ ID NO: 787 - DNA, 24 bp, Artificial Sequence
  Synthetic oligonucleotide
gcactttgggattctttccattat

SEQ ID NO: 788 - DNA, 29 bp, Artificial Sequence
  Synthetic oligonucleotide
acaacattctcggtgcctgtaacaaagaa

SEQ ID NO: 789 - DNA, 24 bp, Artificial Sequence
  Synthetic oligonucleotide
gcatgtaagaagaccctcactgaa

SEQ ID NO: 790 - DNA, 18 bp, Artificial Sequence
  Synthetic oligonucleotide
gcctcttcctgttcgacg

SEQ ID NO: 791 - DNA, 24 bp, Artificial Sequence
  Synthetic oligonucleotide
tcgcccacctacgtactggcctac

SEQ ID NO: 792 - DNA, 18 bp, Artificial Sequence
  Synthetic oligonucleotide
gctttgcccggtagctct

SEQ ID NO: 793 - DNA, 28 bp, Artificial Sequence
  Synthetic oligonucleotide
ggctattcctcattttctctacaaagtg

SEQ ID NO: 794 - DNA, 30 bp, Artificial Sequence
  Synthetic oligonucleotide
cctccaggaggctaccttcttcatgttcac

SEQ ID NO: 795 - DNA, 25 bp, Artificial Sequence
  Synthetic oligonucleotide
ggattgtagactgtcaccgaaattc

SEQ ID NO: 796 - DNA, 20 bp, Artificial Sequence
  Synthetic oligonucleotide
ccccagtttcaacgagactt

SEQ ID NO: 797 - DNA, 27 bp, Artificial Sequence
  Synthetic oligonucleotide
tcattgctccctaaagagttggcactc

SEQ ID NO: 798 - DNA, 20 bp, Artificial Sequence
  Synthetic oligonucleotide
gttccaggaatgaaagcaca

SEQ ID NO: 799 - DNA, 22 bp, Artificial Sequence
  Synthetic oligonucleotide
gagatgattcagttaccgggag

SEQ ID NO: 800 - DNA, 24 bp, Artificial Sequence
  Synthetic oligonucleotide
aatccacaggatccaaaatgggcc

SEQ ID NO: 801 - DNA, 20 bp, Artificial Sequence
  Synthetic oligonucleotide
atcttgtcctggagacccaa

SEQ ID NO: 802 - DNA, 18 bp, Artificial Sequence
  Synthetic oligonucleotide
ctctgcaggcctaggtgc

SEQ ID NO: 803 - DNA, 24 bp, Artificial Sequence
  Synthetic oligonucleotide
ctcctcagcggctccagctcatat

SEQ ID NO: 804 - DNA, 21 bp, Artificial Sequence
  Synthetic oligonucleotide
ccaggactgtgaagagctgtc

SEQ ID NO: 805 - DNA, 21 bp, Artificial Sequence
  Synthetic oligonucleotide
cggtagtcaagtccggatcaa

SEQ ID NO: 806 - DNA, 25 bp, Artificial Sequence
  Synthetic oligonucleotide
caaggagacggaattctacctgtgc

SEQ ID NO: 807 - DNA, 18 bp, Artificial Sequence
  Synthetic oligonucleotide
gcttgcctttgcggttca

SEQ ID NO: 808 - DNA, 20 bp, Artificial Sequence
  Synthetic oligonucleotide
agatgcaggagagaggaagc

SEQ ID NO: 809 - DNA, 24 bp, Artificial Sequence
  Synthetic oligonucleotide
cctgcagactgctttttgcccaat

SEQ ID NO: 810 - DNA, 20 bp, Artificial Sequence
  Synthetic oligonucleotide
gttttgcagccttacccaat

SEQ ID NO: 811 - DNA, 20 bp, Artificial Sequence
  Synthetic oligonucleotide
cacgggacattcaccacatc

SEQ ID NO: 812 - DNA, 27 bp, Artificial Sequence
  Synthetic oligonucleotide
ataaaaagacaaccaacggccgactgc

SEQ ID NO: 813 - DNA, 19 bp, Artificial Sequence
  Synthetic oligonucleotide
gggtgccatccacttcaca

SEQ ID NO: 814 - DNA, 19 bp, Artificial Sequence
  Synthetic oligonucleotide
gagggactgttggcatgca

SEQ ID NO: 815 - DNA, 27 bp, Artificial Sequence
  Synthetic oligonucleotide
tcccagagaccaacgttcaagcagttg

SEQ ID NO: 816 - DNA, 25 bp, Artificial Sequence
  Synthetic oligonucleotide
gagtgagaattcgatccaagtcttc

SEQ ID NO: 817 - DNA, 18 bp, Artificial Sequence
  Synthetic oligonucleotide
ccagtggagcgcttccat

SEQ ID NO: 818 - DNA, 23 bp, Artificial Sequence
  Synthetic oligonucleotide
tcggccacttcatcaggacgcag

SEQ ID NO: 819 - DNA, 22 bp, Artificial Sequence
  Synthetic oligonucleotide
ctctctgggtcgtctgaaacaa

SEQ ID NO: 820 - DNA, 22 bp, Artificial Sequence
  Synthetic oligonucleotide
ggttccagctttctgtagctgt

SEQ ID NO: 821 - DNA, 24 bp, Artificial Sequence
  Synthetic oligonucleotide
attggtggccacaccacctcctta

SEQ ID NO: 822 - DNA, 19 bp, Artificial Sequence
  Synthetic oligonucleotide
gccgcaggttctagttgct

SEQ ID NO: 823 - DNA, 19 bp, Artificial Sequence
  Synthetic oligonucleotide
ccaccagcatgaagtttcg

SEQ ID NO: 824 - DNA, 24 bp, Artificial Sequence
  Synthetic oligonucleotide
acccctcacaaaggccatgtctgt

SEQ ID NO: 825 - DNA, 20 bp, Artificial Sequence
  Synthetic oligonucleotide
ggctgtctgaagcacaactg

SEQ ID NO: 826 - DNA, 19 bp, Artificial Sequence
  Synthetic oligonucleotide
gccacacaaacatgctcct

SEQ ID NO: 827 - DNA, 24 bp, Artificial Sequence
  Synthetic oligonucleotide
atgtctttcccagcagctctgcct

SEQ ID NO: 828 - DNA, 18 bp, Artificial Sequence
  Synthetic oligonucleotide
gccacaggaaacttccga

SEQ ID NO: 829 - DNA, 20 bp, Artificial Sequence
  Synthetic oligonucleotide
ggctcccgaatctatctttg

SEQ ID NO: 830 - DNA, 24 bp, Artificial Sequence
  Synthetic oligonucleotide
ctacagcaccaagagcgacgtgtg

SEQ ID NO: 831 - DNA, 20 bp, Artificial Sequence
  Synthetic oligonucleotide
tcccacagcaatactccgta

SEQ ID NO: 832 - DNA, 20 bp, Artificial Sequence
  Synthetic oligonucleotide
accaagaagctgaggacctg

SEQ ID NO: 833 - DNA, 23 bp, Artificial Sequence
  Synthetic oligonucleotide
agcccgctgaccatggaagatct

SEQ ID NO: 834 - DNA, 20 bp, Artificial Sequence
  Synthetic oligonucleotide
cctggaagctgtagcagaca

SEQ ID NO: 835 - DNA, 21 bp, Artificial Sequence
  Synthetic oligonucleotide
cgagccctttgatgacttcct

SEQ ID NO: 836 - DNA, 22 bp, Artificial Sequence
  Synthetic oligonucleotide
tcccagcatcatccaggcccag

SEQ ID NO: 837 - DNA, 18 bp, Artificial Sequence
  Synthetic oligonucleotide
ggagcgggctgtctcaga

SEQ ID NO: 838 - DNA, 20 bp, Artificial Sequence
  Synthetic oligonucleotide
tgaagtccaggacgatgatg

SEQ ID NO: 839 - DNA, 24 bp, Artificial Sequence
  Synthetic oligonucleotide
ctctacagcagctcagccagcctg

SEQ ID NO: 840 - DNA, 20 bp, Artificial Sequence
  Synthetic oligonucleotide
acggcttgcttactgaaggt

SEQ ID NO: 841 - DNA, 18 bp, Artificial Sequence
  Synthetic oligonucleotide
cagccctgccagtttgac

SEQ ID NO: 842 - DNA, 24 bp, Artificial Sequence
  Synthetic oligonucleotide
atgccgtcttctgccctaacctga

SEQ ID NO: 843 - DNA, 19 bp, Artificial Sequence
  Synthetic oligonucleotide
gttgcctgtggatgacacc

SEQ ID NO: 844 - DNA, 20 bp, Artificial Sequence
  Synthetic oligonucleotide
ttggtacctgtgggttagca

SEQ ID NO: 845 - DNA, 26 bp, Artificial Sequence
  Synthetic oligonucleotide
tccccagggtagaattcaatcagagc

SEQ ID NO: 846 - DNA, 20 bp, Artificial Sequence
  Synthetic oligonucleotide
cacatccaaatgcaaactgg

SEQ ID NO: 847 - DNA, 23 bp, Artificial Sequence
  Synthetic oligonucleotide
gtaagtcggatgagcctgtctgt

SEQ ID NO: 848 - DNA, 26 bp, Artificial Sequence
  Synthetic oligonucleotide
ccagtgacaatgccacttatgccagc

SEQ ID NO: 849 - DNA, 21 bp, Artificial Sequence
  Synthetic oligonucleotide
cagcttccttcatggcacact

SEQ ID NO: 850 - DNA, 24 bp, Artificial Sequence
  Synthetic oligonucleotide
aagtcctcgatacgcactatagca

SEQ ID NO: 851 - DNA, 21 bp, Artificial Sequence
  Synthetic oligonucleotide
cccggatggtctccacgtcat

SEQ ID NO: 852 - DNA, 19 bp, Artificial Sequence
  Synthetic oligonucleotide
ctggcatgtggcacatgag

SEQ ID NO: 853 - DNA, 26 bp, Artificial Sequence
  Synthetic oligonucleotide
ggataattcagacaacaacaccatct

SEQ ID NO: 854 - DNA, 29 bp, Artificial Sequence
  Synthetic oligonucleotide
tcaattgtaacattctcacccaggccttg

SEQ ID NO: 855 - DNA, 25 bp, Artificial Sequence
  Synthetic oligonucleotide
tgaagtaatcagccacagactcaat

SEQ ID NO: 856 - DNA, 19 bp, Artificial Sequence
  Synthetic oligonucleotide
ccgtgctcattgctaacca

SEQ ID NO: 857 - DNA, 24 bp, Artificial Sequence
  Synthetic oligonucleotide
tctgtccctgaactcccagaacca

SEQ ID NO: 858 - DNA, 19 bp, Artificial Sequence
  Synthetic oligonucleotide
ctgcccaaagccagatgta

SEQ ID NO: 859 - DNA, 20 bp, Artificial Sequence
  Synthetic oligonucleotide
cagttcggtccaacagagaa

SEQ ID NO: 860 - DNA, 24 bp, Artificial Sequence
  Synthetic oligonucleotide
agcaggcaaccaccatgtcatttg

SEQ ID NO: 861 - DNA, 20 bp, Artificial Sequence
  Synthetic oligonucleotide
tgcgaattatatcccgatga

SEQ ID NO: 862 - DNA, 20 bp, Artificial Sequence
  Synthetic oligonucleotide
cgtgtgtctcaagacgatcc

SEQ ID NO: 863 - DNA, 24 bp, Artificial Sequence
  Synthetic oligonucleotide
tgtgtaccctaatgggtcccgctt

SEQ ID NO: 864 - DNA, 18 bp, Artificial Sequence
  Synthetic oligonucleotide
ggtccctgtgctgtctgg

SEQ ID NO: 865 - DNA, 20 bp, Artificial Sequence
  Synthetic oligonucleotide
agagcaccaaagcagctcat

SEQ ID NO: 866 - DNA, 24 bp, Artificial Sequence
  Synthetic oligonucleotide
cactgatgacaccacgacgctctc

SEQ ID NO: 867 - DNA, 19 bp, Artificial Sequence
  Synthetic oligonucleotide
gtgcttggggatggtctct

SEQ ID NO: 868 - DNA, 20 bp, Artificial Sequence
  Synthetic oligonucleotide
gaagcgcagatcatgaagaa

SEQ ID NO: 869 - DNA, 24 bp, Artificial Sequence
  Synthetic oligonucleotide
ctgaagcacgacaagctggtccag

SEQ ID NO: 870 - DNA, 20 bp, Artificial Sequence
  Synthetic oligonucleotide
ctcctcagacaccactgcat

SEQ ID NO: 871 - DNA, 20 bp, Artificial Sequence
  Synthetic oligonucleotide
ggtgcaccagttctaccctc

SEQ ID NO: 872 - DNA, 24 bp, Artificial Sequence
  Synthetic oligonucleotide
acttgagctcagcggaacactgca

SEQ ID NO: 873 - DNA, 19 bp, Artificial Sequence
  Synthetic oligonucleotide
gcgtacatggagcacagga

SEQ ID NO: 874 - DNA, 18 bp, Artificial Sequence
  Synthetic oligonucleotide
tggatcctcacctggtcg

SEQ ID NO: 875 - DNA, 24 bp, Artificial Sequence
  Synthetic oligonucleotide
tgcgcttccaccttcttcactgtc

SEQ ID NO: 876 - DNA, 18 bp, Artificial Sequence
  Synthetic oligonucleotide
gcgctgcatgtctaccaa

SEQ ID NO: 877 - DNA, 20 bp, Artificial Sequence
  Synthetic oligonucleotide
aatgagagaggtgaaagcgg

SEQ ID NO: 878 - DNA, 24 bp, Artificial Sequence
  Synthetic oligonucleotide
cggagctagcacccccaggttaag

SEQ ID NO: 879 - DNA, 21 bp, Artificial Sequence
  Synthetic oligonucleotide
aggttcaccacagtcctgttc

SEQ ID NO: 880 - DNA, 19 bp, Artificial Sequence
  Synthetic oligonucleotide
tcagcagcaagggcatcat

SEQ ID NO: 881 - DNA, 19 bp, Artificial Sequence
  Synthetic oligonucleotide
cgcccgcaggcctcatcct

SEQ ID NO: 882 - DNA, 23 bp, Artificial Sequence
  Synthetic oligonucleotide
ggtggttttcttgagcgtgtact

SEQ ID NO: 883 - DNA, 19 bp, Artificial Sequence
  Synthetic oligonucleotide
caacgaattccaggtgtcc

SEQ ID NO: 884 - DNA, 23 bp, Artificial Sequence
  Synthetic oligonucleotide
ctgagcagctccatgtcggtgtc

SEQ ID NO: 885 - DNA, 18 bp, Artificial Sequence
  Synthetic oligonucleotide
gatctgcgccttcagctc

SEQ ID NO: 886 - DNA, 18 bp, Artificial Sequence
  Synthetic oligonucleotide
gtgctggtgacgaatcca

SEQ ID NO: 887 - DNA, 25 bp, Artificial Sequence
  Synthetic oligonucleotide
ttcatctcaatggaaggatcctgcc

SEQ ID NO: 888 - DNA, 20 bp, Artificial Sequence
  Synthetic oligonucleotide
cccggcaaaaacaaataagt

SEQ ID NO: 889 - DNA, 20 bp, Artificial Sequence
  Synthetic oligonucleotide
accctcgacaagaccacact

SEQ ID NO: 890 - DNA, 24 bp, Artificial Sequence
  Synthetic oligonucleotide
aacttcagccccagctcccaagtc

SEQ ID NO: 891 - DNA, 20 bp, Artificial Sequence
  Synthetic oligonucleotide
tgggagttcatgggtacaga

SEQ ID NO: 892 - DNA, 18 bp, Artificial Sequence
  Synthetic oligonucleotide
cgcgctgcagatccattt

SEQ ID NO: 893 - DNA, 23 bp, Artificial Sequence
  Synthetic oligonucleotide
cgctgatccaggctttctgctgc

SEQ ID NO: 894 - DNA, 22 bp, Artificial Sequence
  Synthetic oligonucleotide
cgcactatgtcgatgtcgttct

SEQ ID NO: 895 - DNA, 20 bp, Artificial Sequence
  Synthetic oligonucleotide
ggaacagggtcacccacaga

SEQ ID NO: 896 - DNA, 27 bp, Artificial Sequence
  Synthetic oligonucleotide
tcaggaccatcttcacactcacaccca

SEQ ID NO: 897 - DNA, 19 bp, Artificial Sequence
  Synthetic oligonucleotide
gatttggcgggtccatctc

SEQ ID NO: 898 - DNA, 20 bp, Artificial Sequence
  Synthetic oligonucleotide
ttgggaaatatttgggcatt

SEQ ID NO: 899 - DNA, 26 bp, Artificial Sequence
  Synthetic oligonucleotide
ttgggacattgtagacttggccagac

SEQ ID NO: 900 - DNA, 20 bp, Artificial Sequence
  Synthetic oligonucleotide
agaagctagggtggttgtcc

SEQ ID NO: 901 - DNA, 19 bp, Artificial Sequence
  Synthetic oligonucleotide
gcatgggaaccatcaacca

SEQ ID NO: 902 - DNA, 30 bp, Artificial Sequence
  Synthetic oligonucleotide
ccatggaccaacttcactatgtgacagagc

SEQ ID NO: 903 - DNA, 21 bp, Artificial Sequence
  Synthetic oligonucleotide
tgaggagtttgccttgattcg

SEQ ID NO: 904 - DNA, 20 bp, Artificial Sequence
  Synthetic oligonucleotide
ctgttgcaggaaggcattga

SEQ ID NO: 905 - DNA, 21 bp, Artificial Sequence
  Synthetic oligonucleotide
catctcctggcccagcatgtt

SEQ ID NO: 906 - DNA, 28 bp, Artificial Sequence
  Synthetic oligonucleotide
gtcagtgggtctctaataaagagatgag

SEQ ID NO: 907 - DNA, 30 bp, Artificial Sequence
  Synthetic oligonucleotide
tgtagaatcaaactcttcatcatcaactag

SEQ ID NO: 908 - DNA, 26 bp, Artificial Sequence
  Synthetic oligonucleotide
tgcagttgacatggcctgttcagtcc

SEQ ID NO: 909 - DNA, 22 bp, Artificial Sequence
  Synthetic oligonucleotide
cacagaatccagctgtgcaact

SEQ ID NO: 910 - DNA, 20 bp, Artificial Sequence
  Synthetic oligonucleotide
tggtgcttggagcatagaag

SEQ ID NO: 911 - DNA, 24 bp, Artificial Sequence
  Synthetic oligonucleotide
tgcccttcacaaaggaaatccctg

SEQ ID NO: 912 - DNA, 19 bp, Artificial Sequence
  Synthetic oligonucleotide
gcaacgtcctcagcatttc

SEQ ID NO: 913 - DNA, 21 bp, Artificial Sequence
  Synthetic oligonucleotide
cgctccagacctatgatgact

SEQ ID NO: 914 - DNA, 24 bp, Artificial Sequence
  Synthetic oligonucleotide
tgttagccaaagactgccactgca

SEQ ID NO: 915 - DNA, 20 bp, Artificial Sequence
  Synthetic oligonucleotide
acagtggaaggaccaggact

SEQ ID NO: 916 - DNA, 20 bp, Artificial Sequence
  Synthetic oligonucleotide
gtgtatgacgaggtggatcg

SEQ ID NO: 917 - DNA, 24 bp, Artificial Sequence
  Synthetic oligonucleotide
agccagccacactgcatcattttc

SEQ ID NO: 918 - DNA, 20 bp, Artificial Sequence
  Synthetic oligonucleotide
accagagtgctgtggttttg

SEQ ID NO: 919 - DNA, 19 bp, Artificial Sequence
  Synthetic oligonucleotide
gttcactgggggtgtatgg

SEQ ID NO: 920 - DNA, 24 bp, Artificial Sequence
  Synthetic oligonucleotide
atcccctccctctccacccatcta

SEQ ID NO: 921 - DNA, 23 bp, Artificial Sequence
  Synthetic oligonucleotide
aaataccaacatgcacctctctt

SEQ ID NO: 922 - DNA, 20 bp, Artificial Sequence
  Synthetic oligonucleotide
tgtcatgtacgacggcttct

SEQ ID NO: 923 - DNA, 21 bp, Artificial Sequence
  Synthetic oligonucleotide
aggcgttgcacttcaccagcc

SEQ ID NO: 924 - DNA, 20 bp, Artificial Sequence
  Synthetic oligonucleotide
agtccacagtgttgggacaa

SEQ ID NO: 925 - DNA, 18 bp, Artificial Sequence
  Synthetic oligonucleotide
gcttatgaccgaccccaa

SEQ ID NO: 926 - DNA, 24 bp, Artificial Sequence
  Synthetic oligonucleotide
ctcatcacctggtctccggtgtgt

SEQ ID NO: 927 - DNA, 20 bp, Artificial Sequence
  Synthetic oligonucleotide
aaagttccaggcaacatcgt

SEQ ID NO: 928 - DNA, 24 bp, Artificial Sequence
  Synthetic oligonucleotide
cacacagatctcctactccatcca

SEQ ID NO: 929 - DNA, 26 bp, Artificial Sequence
  Synthetic oligonucleotide
catgctgcatcctaaggctcctcagg

SEQ ID NO: 930 - DNA, 21 bp, Artificial Sequence
  Synthetic oligonucleotide
ggtccagcagtgtctcctgaa

SEQ ID NO: 931 - DNA, 19 bp, Artificial Sequence
  Synthetic oligonucleotide
cttcgcctttgctgattgc

SEQ ID NO: 932 - DNA, 24 bp, Artificial Sequence
  Synthetic oligonucleotide
ctccaaacgcctgcctgacgactg

SEQ ID NO: 933 - DNA, 20 bp, Artificial Sequence
  Synthetic oligonucleotide
ccataacgcacatgctccaa

SEQ ID NO: 934 - DNA, 20 bp, Artificial Sequence
  Synthetic oligonucleotide
tcccactgaagccctttcag

SEQ ID NO: 935 - DNA, 26 bp, Artificial Sequence
  Synthetic oligonucleotide
cctccaagcgagtccttcttcaaccg

SEQ ID NO: 936 - DNA, 20 bp, Artificial Sequence
  Synthetic oligonucleotide
agtgcccaggcgtaaacatc

SEQ ID NO: 937 - DNA, 20 bp, Artificial Sequence
  Synthetic oligonucleotide
gtccatcagtgcatgacgtt

SEQ ID NO: 938 - DNA, 26 bp, Artificial Sequence
  Synthetic oligonucleotide
aggccacgtatagtcctagctgacgc

SEQ ID NO: 939 - DNA, 20 bp, Artificial Sequence
  Synthetic oligonucleotide
agcccacttggtttcttgtt

SEQ ID NO: 940 - DNA, 20 bp, Artificial Sequence
  Synthetic oligonucleotide
ccatctgcatccatcttgtt

SEQ ID NO: 941 - DNA, 23 bp, Artificial Sequence
  Synthetic oligonucleotide
ctccccacccttgagaagtgcct

SEQ ID NO: 942 - DNA, 20 bp, Artificial Sequence
  Synthetic oligonucleotide
ggccaccagggtattatctg

SEQ ID NO: 943 - DNA, 18 bp, Artificial Sequence
  Synthetic oligonucleotide
gttgggtgcatctctcgg

SEQ ID NO: 944 - DNA, 24 bp, Artificial Sequence
  Synthetic oligonucleotide
aattcatgccgagatacagccgct

SEQ ID NO: 945 - DNA, 21 bp, Artificial Sequence
  Synthetic oligonucleotide
cgtgctccatcttcctagctt

SEQ ID NO: 946 - DNA, 23 bp, Artificial Sequence
  Synthetic oligonucleotide
cgaaaagatgctgaacagtgaca

SEQ ID NO: 947 - DNA, 28 bp, Artificial Sequence
  Synthetic oligonucleotide
cttcctcctcccttctggtcagttggat

SEQ ID NO: 948 - DNA, 20 bp, Artificial Sequence
  Synthetic oligonucleotide
tcaggaacagccaccagtga

SEQ ID NO: 949 - DNA, 23 bp, Artificial Sequence
  Synthetic oligonucleotide
ctgggtctcatagaagcaaagga

SEQ ID NO: 950 - DNA, 25 bp, Artificial Sequence
  Synthetic oligonucleotide
agaaaccaccagccacctcaaccca

SEQ ID NO: 951 - DNA, 19 bp, Artificial Sequence
  Synthetic oligonucleotide
ccacgaaggctgctgattg

SEQ ID NO: 952 - DNA, 18 bp, Artificial Sequence
  Synthetic oligonucleotide
atgctgctggccattcca

SEQ ID NO: 953 - DNA, 27 bp, Artificial Sequence
  Synthetic oligonucleotide
ccgtgttttctgacctccatcccttcc

SEQ ID NO: 954 - DNA, 21 bp, Artificial Sequence
  Synthetic oligonucleotide
aggtctggttggtgctttcct

SEQ ID NO: 955 - DNA, 18 bp, Artificial Sequence
  Synthetic oligonucleotide
gacaaggacggcagcaag

SEQ ID NO: 956 - DNA, 24 bp, Artificial Sequence
  Synthetic oligonucleotide
ccaggagttgccaccactgttgtc

SEQ ID NO: 957 - DNA, 18 bp, Artificial Sequence
  Synthetic oligonucleotide
ttgtggcctgtctggacc

SEQ ID NO: 958 - DNA, 20 bp, Artificial Sequence
  Synthetic oligonucleotide
tctccaacttccctctgctg

SEQ ID NO: 959 - DNA, 24 bp, Artificial Sequence
  Synthetic oligonucleotide
aggccctgaaaaccagaatcagca

SEQ ID NO: 960 - DNA, 18 bp, Artificial Sequence
  Synthetic oligonucleotide
acttcttcaccgtgggca

SEQ ID NO: 961 - DNA, 27 bp, Artificial Sequence
  Synthetic oligonucleotide
aagctatgaggaaaagaagtacacgat

SEQ ID NO: 962 - DNA, 30 bp, Artificial Sequence
  Synthetic oligonucleotide
tcagccactggcttctgtcataatcaggag

SEQ ID NO: 963 - DNA, 20 bp, Artificial Sequence
  Synthetic oligonucleotide
ggcccagcttgaatttttca

SEQ ID NO: 964 - DNA, 21 bp, Artificial Sequence
  Synthetic oligonucleotide
caatgccatcttgcgctacat

SEQ ID NO: 965 - DNA, 27 bp, Artificial Sequence
  Synthetic oligonucleotide
ctcgcaagcacaacatgtgtggtgaga

SEQ ID NO: 966 - DNA, 25 bp, Artificial Sequence
  Synthetic oligonucleotide
gtccactcgaatcttttcttcttca

SEQ ID NO: 967 - DNA, 20 bp, Artificial Sequence
  Synthetic oligonucleotide
gagaccctgctgtcccagaa

SEQ ID NO: 968 - DNA, 26 bp, Artificial Sequence
  Synthetic oligonucleotide
tcccacaatgaaggtcttgcctccct

SEQ ID NO: 969 - DNA, 23 bp, Artificial Sequence
  Synthetic oligonucleotide
ggttgtagtcagcgaaggagatc

SEQ ID NO: 970 - DNA, 19 bp, Artificial Sequence
  Synthetic oligonucleotide
caccatccccaccctgtct

SEQ ID NO: 971 - DNA, 23 bp, Artificial Sequence
  Synthetic oligonucleotide
cacagccgcctgaaagccacaat

SEQ ID NO: 972 - DNA, 21 bp, Artificial Sequence
  Synthetic oligonucleotide
ggcctcagtgtgcatcattct

SEQ ID NO: 973 - DNA, 18 bp, Artificial Sequence
  Synthetic oligonucleotide
ccggaaaggccaagacaa

SEQ ID NO: 974 - DNA, 19 bp, Artificial Sequence
  Synthetic oligonucleotide
cccgctcgcagagagccgg

SEQ ID NO: 975 - DNA, 20 bp, Artificial Sequence
  Synthetic oligonucleotide
aatacggcccactgggaact

SEQ ID NO: 976 - DNA, 20 bp, Artificial Sequence
  Synthetic oligonucleotide
gactccttcgtccccagttg

SEQ ID NO: 977 - DNA, 25 bp, Artificial Sequence
  Synthetic oligonucleotide
ttgggcctcccataattgctttgcc

SEQ ID NO: 978 - DNA, 21 bp, Artificial Sequence
  Synthetic oligonucleotide
tggcacttgaaggctctggta

SEQ ID NO: 979 - DNA, 23 bp, Artificial Sequence
  Synthetic oligonucleotide
tgacacccttaccttcctgagaa

SEQ ID NO: 980 - DNA, 21 bp, Artificial Sequence
  Synthetic oligonucleotide
tctgctttccgcgctcccagg

SEQ ID NO: 981 - DNA, 29 bp, Artificial Sequence
  Synthetic oligonucleotide
aaaaacacgagtcaaaaatagaagtcact

SEQ ID NO: 982 - DNA, 27 bp, Artificial Sequence
  Synthetic oligonucleotide
caagtaccacagcgatgactacattaa

SEQ ID NO: 983 - DNA, 23 bp, Artificial Sequence
  Synthetic oligonucleotide
ttcttgcgctccatccgtccaga

SEQ ID NO: 984 - DNA, 22 bp, Artificial Sequence
  Synthetic oligonucleotide
gcttgctgtactccgacatgtt

SEQ ID NO: 985 - DNA, 20 bp, Artificial Sequence
  Synthetic oligonucleotide
ggtggctacacaatccgtaa

SEQ ID NO: 986 - DNA, 27 bp, Artificial Sequence
  Synthetic oligonucleotide
tgcagtctcatatgtccaacatcgagc

SEQ ID NO: 987 - DNA, 20 bp, Artificial Sequence
  Synthetic oligonucleotide
tgggaatctcacaatcaagg

SEQ ID NO: 988 - DNA, 20 bp, Artificial Sequence
  Synthetic oligonucleotide
tcctaggcattctggacctc

SEQ ID NO: 989 - DNA, 24 bp, Artificial Sequence
  Synthetic oligonucleotide
cattcctacccctgatcccaaccc

SEQ ID NO: 990 - DNA, 20 bp, Artificial Sequence
  Synthetic oligonucleotide
gctgttgatgctccatcctt

SEQ ID NO: 991 - DNA, 19 bp, Artificial Sequence
  Synthetic oligonucleotide
agccgtgactgttgaggtc

SEQ ID NO: 992 - DNA, 21 bp, Artificial Sequence
  Synthetic oligonucleotide
aagtccagcatcgcaggcagc

SEQ ID NO: 993 - DNA, 20 bp, Artificial Sequence
  Synthetic oligonucleotide
aagtaacgttcccaggtgct

SEQ ID NO: 994 - DNA, 20 bp, Artificial Sequence
  Synthetic oligonucleotide
aggctgctggaggtcatctc

SEQ ID NO: 995 - DNA, 21 bp, Artificial Sequence
  Synthetic oligonucleotide
ccagaggccgtttcttggccg

SEQ ID NO: 996 - DNA, 19 bp, Artificial Sequence
  Synthetic oligonucleotide
cttcctgcggccacagtct

SEQ ID NO: 997 - DNA, 20 bp, Artificial Sequence
  Synthetic oligonucleotide
cggtgtgagaagtgcagcaa

SEQ ID NO: 998 - DNA, 24 bp, Artificial Sequence
  Synthetic oligonucleotide
ccagaccatagcacactcgggcac

SEQ ID NO: 999 - DNA, 19 bp, Artificial Sequence
  Synthetic oligonucleotide
cctctcgcaagtgctccat

SEQ ID NO: 1000 - DNA, 20 bp, Artificial Sequence
  Synthetic oligonucleotide
caccctgtcctatccttcct

SEQ ID NO: 1001 - DNA, 25 bp, Artificial Sequence
  Synthetic oligonucleotide
ccctcttgggacctagtctctgcct

SEQ ID NO: 1002 - DNA, 20 bp, Artificial Sequence
  Synthetic oligonucleotide
ggccaggggtagagagtaga

SEQ ID NO: 1003 - DNA, 19 bp, Artificial Sequence
  Synthetic oligonucleotide
ttagggaccctgcagctct

SEQ ID NO: 1004 - DNA, 23 bp, Artificial Sequence
  Synthetic oligonucleotide
tagctccctccctccacccactc

SEQ ID NO: 1005 - DNA, 22 bp, Artificial Sequence
  Synthetic oligonucleotide
ctacaaaattcttcctcctgcc

SEQ ID NO: 1006 - DNA, 20 bp, Artificial Sequence
  Synthetic oligonucleotide
ccgaaatccagatgatgatg

SEQ ID NO: 1007 - DNA, 23 bp, Artificial Sequence
  Synthetic oligonucleotide
ctcatggaccctggtgctacacg

SEQ ID NO: 1008 - DNA, 20 bp, Artificial Sequence
  Synthetic oligonucleotide
cccaaggaatgagtggattt

SEQ ID NO: 1009 - DNA, 24 bp, Artificial Sequence
  Synthetic oligonucleotide
tgaacataaagtctgcaacatgga

SEQ ID NO: 1010 - DNA, 24 bp, Artificial Sequence
  Synthetic oligonucleotide
ttgcactgcacaggccacattcac

SEQ ID NO: 1011 - DNA, 28 bp, Artificial Sequence
  Synthetic oligonucleotide
tgaggttggttactgttggtatcatata

SEQ ID NO: 1012 - DNA, 18 bp, Artificial Sequence
  Synthetic oligonucleotide
tacgcacagaggcaagca

SEQ ID NO: 1013 - DNA, 24 bp, Artificial Sequence
  Synthetic oligonucleotide
taagagtccgggatccccagccta

SEQ ID NO: 1014 - DNA, 20 bp, Artificial Sequence
  Synthetic oligonucleotide
gagagaagtgctggagaggc

SEQ ID NO: 1015 - DNA, 21 bp, Artificial Sequence
  Synthetic oligonucleotide
tccatgatggttctgcaggtt

SEQ ID NO: 1016 - DNA, 21 bp, Artificial Sequence
  Synthetic oligonucleotide
ccccggacagtggctctgacg

SEQ ID NO: 1017 - DNA, 21 bp, Artificial Sequence
  Synthetic oligonucleotide
tgagcagcaccatcagtaacg

SEQ ID NO: 1018 - DNA, 20 bp, Artificial Sequence
  Synthetic oligonucleotide
gacgatttgccagctttgag

SEQ ID NO: 1019 - DNA, 24 bp, Artificial Sequence
  Synthetic oligonucleotide
tcaaggtgcattggccaacatagc

SEQ ID NO: 1020 - DNA, 18 bp, Artificial Sequence
  Synthetic oligonucleotide
tccaggttggctttgtcc

SEQ ID NO: 1021 - DNA, 20 bp, Artificial Sequence
  Synthetic oligonucleotide
gctttctcaggacctggttg

SEQ ID NO: 1022 - DNA, 24 bp, Artificial Sequence
  Synthetic oligonucleotide
cattttctgcagttgccgaaccag

SEQ ID NO: 1023 - DNA, 18 bp, Artificial Sequence
  Synthetic oligonucleotide
aggaagccacaagggagg

SEQ ID NO: 1024 - DNA, 19 bp, Artificial Sequence
  Synthetic oligonucleotide
cctgcgcggctactacaac

SEQ ID NO: 1025 - DNA, 25 bp, Artificial Sequence
  Synthetic oligonucleotide
cgaggccagttctcacaccctccag

SEQ ID NO: 1026 - DNA, 19 bp, Artificial Sequence
  Synthetic oligonucleotide
caggtcgcagccaatcatc

SEQ ID NO: 1027 - DNA, 19 bp, Artificial Sequence
  Synthetic oligonucleotide
tggcctgtccattggtgat

SEQ ID NO: 1028 - DNA, 28 bp, Artificial Sequence
  Synthetic oligonucleotide
ttccacatctctcccagtttcttcgcaa

SEQ ID NO: 1029 - DNA, 22 bp, Artificial Sequence
  Synthetic oligonucleotide
gcttgtcatctgcagcagtgtt

SEQ ID NO: 1030 - DNA, 20 bp, Artificial Sequence
  Synthetic oligonucleotide
ctacttccagcaaccccaga

SEQ ID NO: 1031 - DNA, 20 bp, Artificial Sequence
  Synthetic oligonucleotide
tccacatcagaatcttcccg

SEQ ID NO: 1032 - DNA, 20 bp, Artificial Sequence
  Synthetic oligonucleotide
ctttcgggaatcatcttcca

SEQ ID NO: 1033 - DNA, 19 bp, Artificial Sequence
  Synthetic oligonucleotide
caagggagcgaccaactga

SEQ ID NO: 1034 - DNA, 28 bp, Artificial Sequence
  Synthetic oligonucleotide
ctccatatccaaacaaagcatgtgtgcg

SEQ ID NO: 1035 - DNA, 28 bp, Artificial Sequence
  Synthetic oligonucleotide
gtttgccaagttaaatttggtacataat

SEQ ID NO: 1036 - DNA, 20 bp, Artificial Sequence
  Synthetic oligonucleotide
gccagtaagaacgaggagga

SEQ ID NO: 1037 - DNA, 24 bp, Artificial Sequence
  Synthetic oligonucleotide
aaggccattcaaactcctccccac

SEQ ID NO: 1038 - DNA, 19 bp, Artificial Sequence
  Synthetic oligonucleotide
cgtcgctgcttcagagtgt

SEQ ID NO: 1039 - DNA, 23 bp, Artificial Sequence
  Synthetic oligonucleotide
agtgacagatggacaatgcaaga

SEQ ID NO: 1040 - DNA, 24 bp, Artificial Sequence
  Synthetic oligonucleotide
tgaactccttcctggaatacccca

SEQ ID NO: 1041 - DNA, 20 bp, Artificial Sequence
  Synthetic oligonucleotide
ccgagtcgccactgctaagt

SEQ ID NO: 1042 - DNA, 22 bp, Artificial Sequence
  Synthetic oligonucleotide
tcccttgtgttccttctgtgaa

SEQ ID NO: 1043 - DNA, 28 bp, Artificial Sequence
  Synthetic oligonucleotide
agccctgttctcgttgccctaattcatc

SEQ ID NO: 1044 - DNA, 24 bp, Artificial Sequence
  Synthetic oligonucleotide
ggcaataaacaggctcatgattaa

SEQ ID NO: 1045 - DNA, 21 bp, Artificial Sequence
  Synthetic oligonucleotide
cgtgccttatggttactttgg

SEQ ID NO: 1046 - DNA, 24 bp, Artificial Sequence
  Synthetic oligonucleotide
acactcggcaggagtagtacccgc

SEQ ID NO: 1047 - DNA, 18 bp, Artificial Sequence
  Synthetic oligonucleotide
cacagggtttcagcgagc

SEQ ID NO: 1048 - DNA, 20 bp, Artificial Sequence
  Synthetic oligonucleotide
cagcctcaagttcggttttc

SEQ ID NO: 1049 - DNA, 24 bp, Artificial Sequence
  Synthetic oligonucleotide
accggagccttcccagaacaaact

SEQ ID NO: 1050 - DNA, 18 bp, Artificial Sequence
  Synthetic oligonucleotide
gttggaagcaaacgcaca

SEQ ID NO: 1051 - DNA, 19 bp, Artificial Sequence
  Synthetic oligonucleotide
ggacgaatacgaccccact

SEQ ID NO: 1052 - DNA, 24 bp, Artificial Sequence
  Synthetic oligonucleotide
accacctgcttccggtaggaatcc

SEQ ID NO: 1053 - DNA, 18 bp, Artificial Sequence
  Synthetic oligonucleotide
gcacgtctccccatcaat

SEQ ID NO: 1054 - DNA, 19 bp, Artificial Sequence
  Synthetic oligonucleotide
ggagatggccgagactgac

SEQ ID NO: 1055 - DNA, 23 bp, Artificial Sequence
  Synthetic oligonucleotide
caagaccgtgcaggacctcacct

SEQ ID NO: 1056 - DNA, 19 bp, Artificial Sequence
  Synthetic oligonucleotide
ctgcaggagtgtctgcacc

SEQ ID NO: 1057 - DNA, 18 bp, Artificial Sequence
  Synthetic oligonucleotide
ctggaccgcacggacatc

SEQ ID NO: 1058 - DNA, 25 bp, Artificial Sequence
  Synthetic oligonucleotide
accgcttctaccaatacctcgccca

SEQ ID NO: 1059 - DNA, 18 bp, Artificial Sequence
  Synthetic oligonucleotide
cgcctcgcgaaagacttg

SEQ ID NO: 1060 - DNA, 20 bp, Artificial Sequence
  Synthetic oligonucleotide
gctttccaagtggggaatta

SEQ ID NO: 1061 - DNA, 24 bp, Artificial Sequence
  Synthetic oligonucleotide
agttgcttccatccaacctggagg

SEQ ID NO: 1062 - DNA, 20 bp, Artificial Sequence
  Synthetic oligonucleotide
tgcctgcgatatttgttagg

SEQ ID NO: 1063 - DNA, 19 bp, Artificial Sequence
  Synthetic oligonucleotide
ctgctgcgacagtccacta

SEQ ID NO: 1064 - DNA, 24 bp, Artificial Sequence
  Synthetic oligonucleotide
agagtgactcccgttgtcccaagg

SEQ ID NO: 1065 - DNA, 18 bp, Artificial Sequence
  Synthetic oligonucleotide
caggttcgctctgggaag

SEQ ID NO: 1066 - DNA, 19 bp, Artificial Sequence
  Synthetic oligonucleotide
ggtccgcttcgtctttcga

SEQ ID NO: 1067 - DNA, 20 bp, Artificial Sequence
  Synthetic oligonucleotide
tgactcccgcggtcccaagg

SEQ ID NO: 1068 - DNA, 19 bp, Artificial Sequence
  Synthetic oligonucleotide
gcacaggttcgctctggaa

SEQ ID NO: 1069 - DNA, 20 bp, Artificial Sequence
  Synthetic oligonucleotide
ttcagtgtgtccagtgcatc

SEQ ID NO: 1070 - DNA, 29 bp, Artificial Sequence
  Synthetic oligonucleotide
cattttcctcagacttgtgaacctccact

SEQ ID NO: 1071 - DNA, 20 bp, Artificial Sequence
  Synthetic oligonucleotide
atctgtttccattggctcct

SEQ ID NO: 1072 - DNA, 24 bp, Artificial Sequence
  Synthetic oligonucleotide
ggctagtagaactggatcccaaca

SEQ ID NO: 1073 - DNA, 30 bp, Artificial Sequence
  Synthetic oligonucleotide
taattagacctaggcctcagctgcactgcc

SEQ ID NO: 1074 - DNA, 20 bp, Artificial Sequence
  Synthetic oligonucleotide
ggtctgcccaaatgcttttc

SEQ ID NO: 1075 - DNA, 19 bp, Artificial Sequence
  Synthetic oligonucleotide
cctccctctggtggtgctt

SEQ ID NO: 1076 - DNA, 26 bp, Artificial Sequence
  Synthetic oligonucleotide
ctcagggcccaccattgaagaggttg

SEQ ID NO: 1077 - DNA, 26 bp, Artificial Sequence
  Synthetic oligonucleotide
gctacatctacacttggttggcttaa

SEQ ID NO: 1078 - DNA, 19 bp, Artificial Sequence
  Synthetic oligonucleotide
ccgactggaggagcataaa

SEQ ID NO: 1079 - DNA, 24 bp, Artificial Sequence
  Synthetic oligonucleotide
cgcacttttctgagcagacgtcca

SEQ ID NO: 1080 - DNA, 19 bp, Artificial Sequence
  Synthetic oligonucleotide
atgctggctgactctgctc

SEQ ID NO: 1081 - DNA, 20 bp, Artificial Sequence
  Synthetic oligonucleotide
caaaaggcagaggctgataa

SEQ ID NO: 1082 - DNA, 27 bp, Artificial Sequence
  Synthetic oligonucleotide
tgaccagatccttcacagacttgtcgt

SEQ ID NO: 1083 - DNA, 20 bp, Artificial Sequence
  Synthetic oligonucleotide
agcgcagtttcataaagcaa

SEQ ID NO: 1084 - DNA, 20 bp, Artificial Sequence
  Synthetic oligonucleotide
gcaagcaacagtagtcgctg

SEQ ID NO: 1085 - DNA, 25 bp, Artificial Sequence
  Synthetic oligonucleotide
tctccaccctttcctttagaacccg

SEQ ID NO: 1086 - DNA, 21 bp, Artificial Sequence
  Synthetic oligonucleotide
ccaactttcacgctaactggt

SEQ ID NO: 1087 - DNA, 20 bp, Artificial Sequence
  Synthetic oligonucleotide
gagtacgtgtgccgagtgtt

SEQ ID NO: 1088 - DNA, 23 bp, Artificial Sequence
  Synthetic oligonucleotide
cagctccgtgcctctagaggcct

SEQ ID NO: 1089 - DNA, 19 bp, Artificial Sequence
  Synthetic oligonucleotide
ctcaatggtgaccaggaca

SEQ ID NO: 1090 - DNA, 24 bp, Artificial Sequence
  Synthetic oligonucleotide
gcagacagtgaccatctacagctt

SEQ ID NO: 1091 - DNA, 20 bp, Artificial Sequence
  Synthetic oligonucleotide
ccggcgcccaacgtgattct

SEQ ID NO: 1092 - DNA, 22 bp, Artificial Sequence
  Synthetic oligonucleotide
cttctgagacctctggcttcgt

SEQ ID NO: 1093 - DNA, 20 bp, Artificial Sequence
  Synthetic oligonucleotide
ggtcatcctgacactgcaac

SEQ ID NO: 1094 - DNA, 21 bp, Artificial Sequence
  Synthetic oligonucleotide
ttgcccacagccaccaaagtg

SEQ ID NO: 1095 - DNA, 20 bp, Artificial Sequence
  Synthetic oligonucleotide
tgcactcaatggtgaaggac

SEQ ID NO: 1096 - DNA, 19 bp, Artificial Sequence
  Synthetic oligonucleotide
agaaccgcaaggtgagcaa

SEQ ID NO: 1097 - DNA, 26 bp, Artificial Sequence
  Synthetic oligonucleotide
tggagattctccagcacgtcatcgac

SEQ ID NO: 1098 - DNA, 21 bp, Artificial Sequence
  Synthetic oligonucleotide
tccaactgaaggtccctgatg

SEQ ID NO: 1099 - DNA, 23 bp, Artificial Sequence
  Synthetic oligonucleotide
aacgactgctactccaagctcaa

SEQ ID NO: 1100 - DNA, 22 bp, Artificial Sequence
  Synthetic oligonucleotide
tgcccagcatcccccagaacaa

SEQ ID NO: 1101 - DNA, 22 bp, Artificial Sequence
  Synthetic oligonucleotide
ggatttccatcttgctcacctt

SEQ ID NO: 1102 - DNA, 20 bp, Artificial Sequence
  Synthetic oligonucleotide
cttcaccaaatcccttcctg

SEQ ID NO: 1103 - DNA, 24 bp, Artificial Sequence
  Synthetic oligonucleotide
tcacagtccttcgctcctgagcac

SEQ ID NO: 1104 - DNA, 20 bp, Artificial Sequence
  Synthetic oligonucleotide
ctctggctcttcaggctaca

SEQ ID NO: 1105 - DNA, 19 bp, Artificial Sequence
  Synthetic oligonucleotide
tggcctggctcttaatttg

SEQ ID NO: 1106 - DNA, 30 bp, Artificial Sequence
  Synthetic oligonucleotide
cttttgttttgcccagtatagactcggaag

SEQ ID NO: 1107 - DNA, 19 bp, Artificial Sequence
  Synthetic oligonucleotide
tgcaatcatgcaagaccac

SEQ ID NO: 1108 - DNA, 20 bp, Artificial Sequence
  Synthetic oligonucleotide
tgacaaccaagcaaatgtga

SEQ ID NO: 1109 - DNA, 24 bp, Artificial Sequence
  Synthetic oligonucleotide
aagttgccccaggtcaccagactc

SEQ ID NO: 1110 - DNA, 20 bp, Artificial Sequence
  Synthetic oligonucleotide
cagtctgcccatgtggtaat

SEQ ID NO: 1111 - DNA, 21 bp, Artificial Sequence
  Synthetic oligonucleotide
tccggagctgtgatctaagga

SEQ ID NO: 1112 - DNA, 24 bp, Artificial Sequence
  Synthetic oligonucleotide
tgtattgcgcacccctcaagcctg

SEQ ID NO: 1113 - DNA, 20 bp, Artificial Sequence
  Synthetic oligonucleotide
cggacagagcgagctgactt

SEQ ID NO: 1114 - DNA, 21 bp, Artificial Sequence
  Synthetic oligonucleotide
gcatggtagccgaagatttca

SEQ ID NO: 1115 - DNA, 28 bp, Artificial Sequence
  Synthetic oligonucleotide
cgcgtcataccaaaatctccgattttga

SEQ ID NO: 1116 - DNA, 30 bp, Artificial Sequence
  Synthetic oligonucleotide
tttccggtaatagtctgtctcatagatatc

SEQ ID NO: 1117 - DNA, 19 bp, Artificial Sequence
  Synthetic oligonucleotide
ccgtgcttccggacaactt

SEQ ID NO: 1118 - DNA, 24 bp, Artificial Sequence
  Synthetic oligonucleotide
taccccgtgggcaagttcttccaa

SEQ ID NO: 1119 - DNA, 20 bp, Artificial Sequence
  Synthetic oligonucleotide
tggactgcttccaggtgtca

SEQ ID NO: 1120 - DNA, 19 bp, Artificial Sequence
  Synthetic oligonucleotide
gtggacagcaccatgaaca

SEQ ID NO: 1121 - DNA, 20 bp, Artificial Sequence
  Synthetic oligonucleotide
cttccggccagcactgcctc

SEQ ID NO: 1122 - DNA, 20 bp, Artificial Sequence
  Synthetic oligonucleotide
ccttcatacccgacttgagg

SEQ ID NO: 1123 - DNA, 17 bp, Artificial Sequence
  Synthetic oligonucleotide
acgcaccgggtgtctga

SEQ ID NO: 1124 - DNA, 24 bp, Artificial Sequence
  Synthetic oligonucleotide
cccaagttccaccccctccattca

SEQ ID NO: 1125 - DNA, 24 bp, Artificial Sequence
  Synthetic oligonucleotide
tgccctttcttgatgatgattatc

SEQ ID NO: 1126 - DNA, 22 bp, Artificial Sequence
  Synthetic oligonucleotide
tggacaagtacgggatgaagct

SEQ ID NO: 1127 - DNA, 24 bp, Artificial Sequence
  Synthetic oligonucleotide
cccgtcaacgtactccatgcctgg

SEQ ID NO: 1128 - DNA, 21 bp, Artificial Sequence
  Synthetic oligonucleotide
cgaaggtgtggcactgaaagt

SEQ ID NO: 1129 - DNA, 20 bp, Artificial Sequence
  Synthetic oligonucleotide
tgaaccgcagagaccaacag

SEQ ID NO: 1130 - DNA, 25 bp, Artificial Sequence
  Synthetic oligonucleotide
atccaggcacctctaccacgccctc

SEQ ID NO: 1131 - DNA, 20 bp, Artificial Sequence
  Synthetic oligonucleotide
gtcttggacacccgcagaat

SEQ ID NO: 1132 - DNA, 23 bp, Artificial Sequence
  Synthetic oligonucleotide
gggtcactatggagttcaaagga

SEQ ID NO: 1133 - DNA, 23 bp, Artificial Sequence
  Synthetic oligonucleotide
cccggtcaccaggcaggagttct

SEQ ID NO: 1134 - DNA, 19 bp, Artificial Sequence
  Synthetic oligonucleotide
gggtctgaatggccaggtt

SEQ ID NO: 1135 - DNA, 20 bp, Artificial Sequence
  Synthetic oligonucleotide
aaggacgaggagaacacagg

SEQ ID NO: 1136 - DNA, 21 bp, Artificial Sequence
  Synthetic oligonucleotide
atgacccagcgctgcaaggac

SEQ ID NO: 1137 - DNA, 20 bp, Artificial Sequence
  Synthetic oligonucleotide
agatagccagcgagttcagg

SEQ ID NO: 1138 - DNA, 26 bp, Artificial Sequence
  Synthetic oligonucleotide
aaggaaccatctcactgtgtgtaaac

SEQ ID NO: 1139 - DNA, 22 bp, Artificial Sequence
  Synthetic oligonucleotide
tgacttccaagctggccgtggc

SEQ ID NO: 1140 - DNA, 20 bp, Artificial Sequence
  Synthetic oligonucleotide
atcaggaaggctgccaagag

SEQ ID NO: 1141 - DNA, 20 bp, Artificial Sequence
  Synthetic oligonucleotide
ggcgctgtcatcgatttctt

SEQ ID NO: 1142 - DNA, 22 bp, Artificial Sequence
  Synthetic oligonucleotide
ctgctccacggccttgctcttg

SEQ ID NO: 1143 - DNA, 25 bp, Artificial Sequence
  Synthetic oligonucleotide
tggagcttattaaaggcattcttca

SEQ ID NO: 1144 - DNA, 20 bp, Artificial Sequence
  Synthetic oligonucleotide
agctgaggaagatgctggtt

SEQ ID NO: 1145 - DNA, 24 bp, Artificial Sequence
  Synthetic oligonucleotide
tgcccacagaccttccaggagaat

SEQ ID NO: 1146 - DNA, 20 bp, Artificial Sequence
  Synthetic oligonucleotide
ggaaagaaggtgctcaggtc

SEQ ID NO: 1147 - DNA, 20 bp, Artificial Sequence
  Synthetic oligonucleotide
cctgaaccttccaaagatgg

SEQ ID NO: 1148 - DNA, 27 bp, Artificial Sequence
  Synthetic oligonucleotide
ccagattggaagcatccatctttttca

SEQ ID NO: 1149 - DNA, 20 bp, Artificial Sequence
  Synthetic oligonucleotide
accaggcaagtctcctcatt

SEQ ID NO: 1150 - DNA, 20 bp, Artificial Sequence
  Synthetic oligonucleotide
ggcctaatgttccagatcct

SEQ ID NO: 1151 - DNA, 25 bp, Artificial Sequence
  Synthetic oligonucleotide
catattgcccagtggtcacctcaca

SEQ ID NO: 1152 - DNA, 20 bp, Artificial Sequence
  Synthetic oligonucleotide
aaaattgtgccttggaggag

SEQ ID NO: 1153 - DNA, 20 bp, Artificial Sequence
  Synthetic oligonucleotide
agccatcactctcagtgcag

SEQ ID NO: 1154 - DNA, 22 bp, Artificial Sequence
  Synthetic oligonucleotide
caggtcctatcgtggcccctga

SEQ ID NO: 1155 - DNA, 20 bp, Artificial Sequence
  Synthetic oligonucleotide
actgcagagtcagggtctcc

SEQ ID NO: 1156 - DNA, 19 bp, Artificial Sequence
  Synthetic oligonucleotide
gaaagtgtttgcggagcac

SEQ ID NO: 1157 - DNA, 24 bp, Artificial Sequence
  Synthetic oligonucleotide
ctcctacagcggccagttcttggt

SEQ ID NO: 1158 - DNA, 18 bp, Artificial Sequence
  Synthetic oligonucleotide
gaaggcgtagccggattt

SEQ ID NO: 1159 - DNA, 21 bp, Artificial Sequence
  Synthetic oligonucleotide
caatctgatcccagggttgaa

SEQ ID NO: 1160 - DNA, 27 bp, Artificial Sequence
  Synthetic oligonucleotide
ctcagcgcacttggcatcttttcaaca

SEQ ID NO: 1161 - DNA, 19 bp, Artificial Sequence
  Synthetic oligonucleotide
ggccctgctggtggagata

SEQ ID NO: 1162 - DNA, 20 bp, Artificial Sequence
  Synthetic oligonucleotide
tgtttccaagatcctgctga

SEQ ID NO: 1163 - DNA, 28 bp, Artificial Sequence
  Synthetic oligonucleotide
ccatctttgctttatctgaggctcgttc

SEQ ID NO: 1164 - DNA, 20 bp, Artificial Sequence
  Synthetic oligonucleotide
tctttctggttggctggaat

SEQ ID NO: 1165 - DNA, 20 bp, Artificial Sequence
  Synthetic oligonucleotide
cctacagcaagtgcaaggaa

SEQ ID NO: 1166 - DNA, 24 bp, Artificial Sequence
  Synthetic oligonucleotide
ccagctgcactttgtcgtcactgt

SEQ ID NO: 1167 - DNA, 20 bp, Artificial Sequence
  Synthetic oligonucleotide
catctcgtaggtctgcatgg

SEQ ID NO: 1168 - DNA, 23 bp, Artificial Sequence
  Synthetic oligonucleotide
cctcccagtttcatcttccacta

SEQ ID NO: 1169 - DNA, 24 bp, Artificial Sequence
  Synthetic oligonucleotide
atgtgcagcccacaaccaccatga

SEQ ID NO: 1170 - DNA, 21 bp, Artificial Sequence
  Synthetic oligonucleotide
agggactggaagggacaggtt

SEQ ID NO: 1171 - DNA, 19 bp, Artificial Sequence
  Synthetic oligonucleotide
gtgcccgagccatatagca

SEQ ID NO: 1172 - DNA, 25 bp, Artificial Sequence
  Synthetic oligonucleotide
acgtccgggtcctcactgtccttcc

SEQ ID NO: 1173 - DNA, 23 bp, Artificial Sequence
  Synthetic oligonucleotide
cggtagtggttgatgactgttga

SEQ ID NO: 1174 - DNA, 20 bp, Artificial Sequence
  Synthetic oligonucleotide
agcctccaggataccagcaa

SEQ ID NO: 1175 - DNA, 23 bp, Artificial Sequence
  Synthetic oligonucleotide
agctaagctgccatttgtcaccg

SEQ ID NO: 1176 - DNA, 21 bp, Artificial Sequence
  Synthetic oligonucleotide
tctccgactgacaggcatttg

SEQ ID NO: 1177 - DNA, 20 bp, Artificial Sequence
  Synthetic oligonucleotide
ccacagctcaccttctgtca

SEQ ID NO: 1178 - DNA, 20 bp, Artificial Sequence
  Synthetic oligonucleotide
tccatcccagctccagccag

SEQ ID NO: 1179 - DNA, 20 bp, Artificial Sequence
  Synthetic oligonucleotide
cctcagtgccagtctcttcc

SEQ ID NO: 1180 - DNA, 20 bp, Artificial Sequence
  Synthetic oligonucleotide
ccatgatcctcactctgctg

SEQ ID NO: 1181 - DNA, 24 bp, Artificial Sequence
  Synthetic oligonucleotide
cactccagacctcgcttagcatgg

SEQ ID NO: 1182 - DNA, 20 bp, Artificial Sequence
  Synthetic oligonucleotide
gaagctttgtagccggtgat

SEQ ID NO: 1183 - DNA, 21 bp, Artificial Sequence
  Synthetic oligonucleotide
caacgcttcagtgatcaatcc

SEQ ID NO: 1184 - DNA, 24 bp, Artificial Sequence
  Synthetic oligonucleotide
cgatcctgcatctgtaaatcgccc

SEQ ID NO: 1185 - DNA, 18 bp, Artificial Sequence
  Synthetic oligonucleotide
gtctggccgggattcttt

SEQ ID NO: 1186 - DNA, 20 bp, Artificial Sequence
  Synthetic oligonucleotide
aggccagccctacattatca

SEQ ID NO: 1187 - DNA, 24 bp, Artificial Sequence
  Synthetic oligonucleotide
tctgagccttgtcctctatccggc

SEQ ID NO: 1188 - DNA, 20 bp, Artificial Sequence
  Synthetic oligonucleotide
gtcttctccacagtccagca

SEQ ID NO: 1189 - DNA, 20 bp, Artificial Sequence
  Synthetic oligonucleotide
cagtgacaaacagcccttcc

SEQ ID NO: 1190 - DNA, 24 bp, Artificial Sequence
  Synthetic oligonucleotide
tcgccatcttttgtgggattcctt

SEQ ID NO: 1191 - DNA, 19 bp, Artificial Sequence
  Synthetic oligonucleotide
gtttagcctcatgggcgtc

SEQ ID NO: 1192 - DNA, 22 bp, Artificial Sequence
  Synthetic oligonucleotide
gatatgattggtcgctgctttg

SEQ ID NO: 1193 - DNA, 21 bp, Artificial Sequence
  Synthetic oligonucleotide
cagccaggacctggccatccg

SEQ ID NO: 1194 - DNA, 21 bp, Artificial Sequence
  Synthetic oligonucleotide
agaacttccattccccaccat

SEQ ID NO: 1195 - DNA, 21 bp, Artificial Sequence
  Synthetic oligonucleotide
actcggactgcacaagctatt

SEQ ID NO: 1196 - DNA, 24 bp, Artificial Sequence
  Synthetic oligonucleotide
ccgacagccacagaataacccaaa

SEQ ID NO: 1197 - DNA, 20 bp, Artificial Sequence
  Synthetic oligonucleotide
tgccatcaccattgaaatct

SEQ ID NO: 1198 - DNA, 20 bp, Artificial Sequence
  Synthetic oligonucleotide
tcagaattggatttggctca

SEQ ID NO: 1199 - DNA, 30 bp, Artificial Sequence
  Synthetic oligonucleotide
tgctaatgtaaggcatcacagtcttttcca

SEQ ID NO: 1200 - DNA, 20 bp, Artificial Sequence
  Synthetic oligonucleotide
cctgagcttagctggtgttg

SEQ ID NO: 1201 - DNA, 19 bp, Artificial Sequence
  Synthetic oligonucleotide
accgggagccctacatgac

SEQ ID NO: 1202 - DNA, 28 bp, Artificial Sequence
  Synthetic oligonucleotide
aaatacctgcaaccgttactgccgtgac

SEQ ID NO: 1203 - DNA, 27 bp, Artificial Sequence
  Synthetic oligonucleotide
ccttaagctctttcactgactcaatct

SEQ ID NO: 1204 - DNA, 18 bp, Artificial Sequence
  Synthetic oligonucleotide
caaggtgccctcagtgga

SEQ ID NO: 1205 - DNA, 24 bp, Artificial Sequence
  Synthetic oligonucleotide
caccaacctgtacccgtattgcga

SEQ ID NO: 1206 - DNA, 19 bp, Artificial Sequence
  Synthetic oligonucleotide
gcgcacaccttcatctcat

SEQ ID NO: 1207 - DNA, 20 bp, Artificial Sequence
  Synthetic oligonucleotide
tcgtgaaagatgaccaggag

SEQ ID NO: 1208 - DNA, 27 bp, Artificial Sequence
  Synthetic oligonucleotide
tgctatgtttctacaaaaccgccaagg

SEQ ID NO: 1209 - DNA, 20 bp, Artificial Sequence
  Synthetic oligonucleotide
ggtgaacatcatgacgcagt

SEQ ID NO: 1210 - DNA, 20 bp, Artificial Sequence
  Synthetic oligonucleotide
gtcaaaatggggagggacta

SEQ ID NO: 1211 - DNA, 29 bp, Artificial Sequence
  Synthetic oligonucleotide
tgtatcttgttgagctatccaaactgccc

SEQ ID NO: 1212 - DNA, 20 bp, Artificial Sequence
  Synthetic oligonucleotide
caggaccaccacagagtgag

SEQ ID NO: 1213 - DNA, 19 bp, Artificial Sequence
  Synthetic oligonucleotide
gagcgcaaagtggaaatcg

SEQ ID NO: 1214 - DNA, 27 bp, Artificial Sequence
  Synthetic oligonucleotide
taggaagcagctcccatctttccggta

SEQ ID NO: 1215 - DNA, 19 bp, Artificial Sequence
  Synthetic oligonucleotide
tcttcacgggcaccacatc

SEQ ID NO: 1216 - DNA, 20 bp, Artificial Sequence
  Synthetic oligonucleotide
tcctgctgctggtcatctac

SEQ ID NO: 1217 - DNA, 24 bp, Artificial Sequence
  Synthetic oligonucleotide
tgtcttcacaccctactcggctgc

SEQ ID NO: 1218 - DNA, 20 bp, Artificial Sequence
  Synthetic oligonucleotide
ccttcttccgtctccttcag

SEQ ID NO: 1219 - DNA, 18 bp, Artificial Sequence
  Synthetic oligonucleotide
cctatcagccgctggtgt

SEQ ID NO: 1220 - DNA, 24 bp, Artificial Sequence
  Synthetic oligonucleotide
atcctgctcggcctggcttacttc

SEQ ID NO: 1221 - DNA, 18 bp, Artificial Sequence
  Synthetic oligonucleotide
tggtggtgagcactgagg

SEQ ID NO: 1222 - DNA, 20 bp, Artificial Sequence
  Synthetic oligonucleotide
gaggacgaaggcctctacac

SEQ ID NO: 1223 - DNA, 24 bp, Artificial Sequence
  Synthetic oligonucleotide
caggcatgcagtgttcttggctgt

SEQ ID NO: 1224 - DNA, 20 bp, Artificial Sequence
  Synthetic oligonucleotide
aaaaatgcctccacttttgc

SEQ ID NO: 1225 - DNA, 19 bp, Artificial Sequence
  Synthetic oligonucleotide
cggactttgggtgcgactt

SEQ ID NO: 1226 - DNA, 23 bp, Artificial Sequence
  Synthetic oligonucleotide
ccacttgtcgaaccaccgctcgt

SEQ ID NO: 1227 - DNA, 24 bp, Artificial Sequence
  Synthetic oligonucleotide
ttacaactcttccactgggacgat

SEQ ID NO: 1228 - DNA, 19 bp, Artificial Sequence
  Synthetic oligonucleotide
gtgtcctggtccatgtggt

SEQ ID NO: 1229 - DNA, 24 bp, Artificial Sequence
  Synthetic oligonucleotide
cacgtgtctccacctccaaggaga

SEQ ID NO: 1230 - DNA, 18 bp, Artificial Sequence
  Synthetic oligonucleotide
gggaggtgcacactgagg

SEQ ID NO: 1231 - DNA, 20 bp, Artificial Sequence
  Synthetic oligonucleotide
ctaaggcacttgctggaagg

SEQ ID NO: 1232 - DNA, 24 bp, Artificial Sequence
  Synthetic oligonucleotide
tccataggcaagcacactggcatt

SEQ ID NO: 1233 - DNA, 18 bp, Artificial Sequence
  Synthetic oligonucleotide
tcttcccagctcctgtgg

SEQ ID NO: 1234 - DNA, 25 bp, Artificial Sequence
  Synthetic oligonucleotide
aattcctgctccaaaagaaagtctt

SEQ ID NO: 1235 - DNA, 22 bp, Artificial Sequence
  Synthetic oligonucleotide
aagccgctccactcgcatgtcc

SEQ ID NO: 1236 - DNA, 20 bp, Artificial Sequence
  Synthetic oligonucleotide
cgtgatgcgaagctctgaga

SEQ ID NO: 1237 - DNA, 20 bp, Artificial Sequence
  Synthetic oligonucleotide
ccacagggttgaagaaccag

SEQ ID NO: 1238 - DNA, 24 bp, Artificial Sequence
  Synthetic oligonucleotide
agccagttcctgctgttcctgtcc

SEQ ID NO: 1239 - DNA, 20 bp, Artificial Sequence
  Synthetic oligonucleotide
cacctgatgtgccagacttc

SEQ ID NO: 1240 - DNA, 18 bp, Artificial Sequence
  Synthetic oligonucleotide
gtccccgggatggatgtt

SEQ ID NO: 1241 - DNA, 29 bp, Artificial Sequence
  Synthetic oligonucleotide
catctcgcttatccaacaatgacttggca

SEQ ID NO: 1242 - DNA, 25 bp, Artificial Sequence
  Synthetic oligonucleotide
gatcagtcaagctgtctgacaattg

SEQ ID NO: 1243 - DNA, 18 bp, Artificial Sequence
  Synthetic oligonucleotide
gtgcaaccgcagcttctc

SEQ ID NO: 1244 - DNA, 24 bp, Artificial Sequence
  Synthetic oligonucleotide
ctctgaccacctggccctgcatat

SEQ ID NO: 1245 - DNA, 18 bp, Artificial Sequence
  Synthetic oligonucleotide
cgggcagtgctcagttct

SEQ ID NO: 1246 - DNA, 20 bp, Artificial Sequence
  Synthetic oligonucleotide
cacgagaccggctacttctc

SEQ ID NO: 1247 - DNA, 24 bp, Artificial Sequence
  Synthetic oligonucleotide
agtactcctccagagacggcagcg

SEQ ID NO: 1248 - DNA, 20 bp, Artificial Sequence
  Synthetic oligonucleotide
gctctaggcaggtctgttgc

SEQ ID NO: 1249 - DNA, 18 bp, Artificial Sequence
  Synthetic oligonucleotide
gcccagaggctccatcgt

SEQ ID NO: 1250 - DNA, 23 bp, Artificial Sequence
  Synthetic oligonucleotide
cctcttcctccccagtcggctga

SEQ ID NO: 1251 - DNA, 23 bp, Artificial Sequence
  Synthetic oligonucleotide
cagaggtttgaacagtgcagaca

SEQ ID NO: 1252 - DNA, 20 bp, Artificial Sequence
  Synthetic oligonucleotide
gacgtgagggtcctgattct

SEQ ID NO: 1253 - DNA, 24 bp, Artificial Sequence
  Synthetic oligonucleotide
ttaccccagctccatccttgcatc

SEQ ID NO: 1254 - DNA, 20 bp, Artificial Sequence
  Synthetic oligonucleotide
tcctcactcatcacgtcctc

SEQ ID NO: 1255 - DNA, 20 bp, Artificial Sequence
  Synthetic oligonucleotide
tgagagccaggcttcttgta

SEQ ID NO: 1256 - DNA, 25 bp, Artificial Sequence
  Synthetic oligonucleotide
tgtctcaaaatgccagccttctgaa

SEQ ID NO: 1257 - DNA, 20 bp, Artificial Sequence
  Synthetic oligonucleotide
atcctggtcctctttgctgt

SEQ ID NO: 1258 - DNA, 20 bp, Artificial Sequence
  Synthetic oligonucleotide
atgtgccagtgagcttgagt

SEQ ID NO: 1259 - DNA, 24 bp, Artificial Sequence
  Synthetic oligonucleotide
ccttggagaaacacaagcacctgc

SEQ ID NO: 1260 - DNA, 20 bp, Artificial Sequence
  Synthetic oligonucleotide
tgagcccctggttaacagta

SEQ ID NO: 1261 - DNA, 19 bp, Artificial Sequence
  Synthetic oligonucleotide
gagaccaaggttgcaaggc

SEQ ID NO: 1262 - DNA, 24 bp, Artificial Sequence
  Synthetic oligonucleotide
aagctcaaaggttcacacagggcc

SEQ ID NO: 1263 - DNA, 22 bp, Artificial Sequence
  Synthetic oligonucleotide
cagtccatgctgtgaaactctc

SEQ ID NO: 1264 - DNA, 21 bp, Artificial Sequence
  Synthetic oligonucleotide
tgagcggcagaatcaggagta

SEQ ID NO: 1265 - DNA, 24 bp, Artificial Sequence
  Synthetic oligonucleotide
ctcatggacatcaagtcgcggctg

SEQ ID NO: 1266 - DNA, 19 bp, Artificial Sequence
  Synthetic oligonucleotide
tgcggtaggtggcaatctc

SEQ ID NO: 1267 - DNA, 27 bp, Artificial Sequence
  Synthetic oligonucleotide
ggatgaagcttacatgaacaaggtaga

SEQ ID NO: 1268 - DNA, 21 bp, Artificial Sequence
  Synthetic oligonucleotide
cgtcggtcagcccttccaggc

SEQ ID NO: 1269 - DNA, 25 bp, Artificial Sequence
  Synthetic oligonucleotide
catatagctgcctgaggaagttgat

SEQ ID NO: 1270 - DNA, 20 bp, Artificial Sequence
  Synthetic oligonucleotide
cagatgaggcacatggagac

SEQ ID NO: 1271 - DNA, 24 bp, Artificial Sequence
  Synthetic oligonucleotide
ctgattcctcaggtccttggcctg

SEQ ID NO: 1272 - DNA, 20 bp, Artificial Sequence
  Synthetic oligonucleotide
ttgaaatggcagaacggtag

SEQ ID NO: 1273 - DNA, 20 bp, Artificial Sequence
  Synthetic oligonucleotide
actgaccaagcctgagacct

SEQ ID NO: 1274 - DNA, 23 bp, Artificial Sequence
  Synthetic oligonucleotide
ccactcgccatactgggtgcagt

SEQ ID NO: 1275 - DNA, 20 bp, Artificial Sequence
  Synthetic oligonucleotide
gtcacacttgcagcatttca

SEQ ID NO: 1276 - DNA, 21 bp, Artificial Sequence
  Synthetic oligonucleotide
actcaagcggaaattgaagca

SEQ ID NO: 1277 - DNA, 28 bp, Artificial Sequence
  Synthetic oligonucleotide
aggtcttatcagcacagtctccgcctcc

SEQ ID NO: 1278 - DNA, 21 bp, Artificial Sequence
  Synthetic oligonucleotide
actccctgaagccgagacact

SEQ ID NO: 1279 - DNA, 18 bp, Artificial Sequence
  Synthetic oligonucleotide
gtgaacgttccggagagc

SEQ ID NO: 1280 - DNA, 24 bp, Artificial Sequence
  Synthetic oligonucleotide
atccagagacgcttctgcgctctc

SEQ ID NO: 1281 - DNA, 20 bp, Artificial Sequence
  Synthetic oligonucleotide
acattcacatactcccggct

SEQ ID NO: 1282 - DNA, 19 bp, Artificial Sequence
  Synthetic oligonucleotide
cgctgggcaacattaagag

SEQ ID NO: 1283 - DNA, 24 bp, Artificial Sequence
  Synthetic oligonucleotide
tcaccactcggacgaggtaactcg

SEQ ID NO: 1284 - DNA, 21 bp, Artificial Sequence
  Synthetic oligonucleotide
agcatgctggttgtagttggt

SEQ ID NO: 1285 - DNA, 18 bp, Artificial Sequence
  Synthetic oligonucleotide
cagtgcctctcgcctgtc

SEQ ID NO: 1286 - DNA, 23 bp, Artificial Sequence
  Synthetic oligonucleotide
actgggacaagcctgacagcagc

SEQ ID NO: 1287 - DNA, 21 bp, Artificial Sequence
  Synthetic oligonucleotide
tgaagaggtcatcctgctctg

SEQ ID NO: 1288 - DNA, 19 bp, Artificial Sequence
  Synthetic oligonucleotide
gatgacggaaagcatccag

SEQ ID NO: 1289 - DNA, 24 bp, Artificial Sequence
  Synthetic oligonucleotide
tggaggcctctacaacaagggacc

SEQ ID NO: 1290 - DNA, 21 bp, Artificial Sequence
  Synthetic oligonucleotide
cccggaataactcgagtagga

SEQ ID NO: 1291 - DNA, 20 bp, Artificial Sequence
  Synthetic oligonucleotide
agcggaaaatggcagacaat

SEQ ID NO: 1292 - DNA, 25 bp, Artificial Sequence
  Synthetic oligonucleotide
acccagataacgcatcatggagcga

SEQ ID NO: 1293 - DNA, 20 bp, Artificial Sequence
  Synthetic oligonucleotide
cttgagggtttgggtttcca

SEQ ID NO: 1294 - DNA, 21 bp, Artificial Sequence
  Synthetic oligonucleotide
ttggtgccgttcctatagatg

SEQ ID NO: 1295 - DNA, 24 bp, Artificial Sequence
  Synthetic oligonucleotide
cagtgcttgcctccatcttcagga

SEQ ID NO: 1296 - DNA, 18 bp, Artificial Sequence
  Synthetic oligonucleotide
gaacctgccacgatcacc

SEQ ID NO: 1297 - DNA, 21 bp, Artificial Sequence
  Synthetic oligonucleotide
cacctggtctgggaagatacc

SEQ ID NO: 1298 - DNA, 24 bp, Artificial Sequence
  Synthetic oligonucleotide
accgagaccccaatcaaaacctcc

SEQ ID NO: 1299 - DNA, 19 bp, Artificial Sequence
  Synthetic oligonucleotide
aagagcagcaggacgaagg

SEQ ID NO: 1300 - DNA, 19 bp, Artificial Sequence
  Synthetic oligonucleotide
tgcaaacgctggtgtcaca

SEQ ID NO: 1301 - DNA, 22 bp, Artificial Sequence
  Synthetic oligonucleotide
cagccccccaactgacctcatc

SEQ ID NO: 1302 - DNA, 21 bp, Artificial Sequence
  Synthetic oligonucleotide
ccccacgagttctggttcttc

SEQ ID NO: 1303 - DNA, 20 bp, Artificial Sequence
  Synthetic oligonucleotide
cccatccagaacactgattg

SEQ ID NO: 1304 - DNA, 26 bp, Artificial Sequence
  Synthetic oligonucleotide
tgacctccatccctttcacttgaatg

SEQ ID NO: 1305 - DNA, 21 bp, Artificial Sequence
  Synthetic oligonucleotide
ctgctttctatgcaccctttc

SEQ ID NO: 1306 - DNA, 18 bp, Artificial Sequence
  Synthetic oligonucleotide
ccaatgggagaacaacgg

SEQ ID NO: 1307 - DNA, 24 bp, Artificial Sequence
  Synthetic oligonucleotide
caggctcagcaagctgaacacctg

SEQ ID NO: 1308 - DNA, 19 bp, Artificial Sequence
  Synthetic oligonucleotide
cgctgaggctggtactgtg

SEQ ID NO: 1309 - DNA, 19 bp, Artificial Sequence
  Synthetic oligonucleotide
tcagcgggctcttaaacaa

SEQ ID NO: 1310 - DNA, 24 bp, Artificial Sequence
  Synthetic oligonucleotide
cagctgtccccgcagtaaagaagc

SEQ ID NO: 1311 - DNA, 20 bp, Artificial Sequence
  Synthetic oligonucleotide
aagacaggagttgaccacgc

SEQ ID NO: 1312 - DNA, 20 bp, Artificial Sequence
  Synthetic oligonucleotide
cgactatgacccactggaca

SEQ ID NO: 1313 - DNA, 24 bp, Artificial Sequence
  Synthetic oligonucleotide
cgcccatccacccagtagatgaac

SEQ ID NO: 1314 - DNA, 19 bp, Artificial Sequence
  Synthetic oligonucleotide
cttggctcgcttgatgttc

SEQ ID NO: 1315 - DNA, 20 bp, Artificial Sequence
  Synthetic oligonucleotide
ggatgtagccatctctgcct

SEQ ID NO: 1316 - DNA, 24 bp, Artificial Sequence
  Synthetic oligonucleotide
atagacctcagggccttcgctgtg

SEQ ID NO: 1317 - DNA, 20 bp, Artificial Sequence
  Synthetic oligonucleotide
agttcaaagccaatagggca

SEQ ID NO: 1318 - DNA, 21 bp, Artificial Sequence
  Synthetic oligonucleotide
aatgctgatgacttggagcag

SEQ ID NO: 1319 - DNA, 24 bp, Artificial Sequence
  Synthetic oligonucleotide
cacagaccccacagaggatgaagc

SEQ ID NO: 1320 - DNA, 18 bp, Artificial Sequence
  Synthetic oligonucleotide
ctgcatcctctgtggggt

SEQ ID NO: 1321 - DNA, 26 bp, Artificial Sequence
  Synthetic oligonucleotide
tggttctgattaggtaacgtattgga

SEQ ID NO: 1322 - DNA, 25 bp, Artificial Sequence
  Synthetic oligonucleotide
ctgcccacaactcccttgcacgtaa

SEQ ID NO: 1323 - DNA, 21 bp, Artificial Sequence
  Synthetic oligonucleotide
ggtcaaggtgggacactgaag

SEQ ID NO: 1324 - DNA, 20 bp, Artificial Sequence
  Synthetic oligonucleotide
agaagctgtccctgcaagag

SEQ ID NO: 1325 - DNA, 25 bp, Artificial Sequence
  Synthetic oligonucleotide
catgttcttcacaatcgctgcatcc

SEQ ID NO: 1326 - DNA, 20 bp, Artificial Sequence
  Synthetic oligonucleotide
agccgtaccagctcagactt

SEQ ID NO: 1327 - DNA, 18 bp, Artificial Sequence
  Synthetic oligonucleotide
ccgggagcagggaatcac

SEQ ID NO: 1328 - DNA, 19 bp, Artificial Sequence
  Synthetic oligonucleotide
cggccacgatttcggcgct

SEQ ID NO: 1329 - DNA, 20 bp, Artificial Sequence
  Synthetic oligonucleotide
atgctgttgatgccgaatga

SEQ ID NO: 1330 - DNA, 23 bp, Artificial Sequence
  Synthetic oligonucleotide
gctgcctttggtaagaacatgtc

SEQ ID NO: 1331 - DNA, 22 bp, Artificial Sequence
  Synthetic oligonucleotide
tccatcttgccattcacgccgc

SEQ ID NO: 1332 - DNA, 23 bp, Artificial Sequence
  Synthetic oligonucleotide
atcccagcagtctcttcacaact

SEQ ID NO: 1333 - DNA, 22 bp, Artificial Sequence
  Synthetic oligonucleotide
ggacattactggcctgttcaca

SEQ ID NO: 1334 - DNA, 23 bp, Artificial Sequence
  Synthetic oligonucleotide
tgcattccagcctcccatttcca

SEQ ID NO: 1335 - DNA, 23 bp, Artificial Sequence
  Synthetic oligonucleotide
accaatactcaggagcaggatga

SEQ ID NO: 1336 - DNA, 20 bp, Artificial Sequence
  Synthetic oligonucleotide
tccatcaaggctttcgacta

SEQ ID NO: 1337 - DNA, 22 bp, Artificial Sequence
  Synthetic oligonucleotide
ctgcaggctgtacgccttctcg

SEQ ID NO: 1338 - DNA, 20 bp, Artificial Sequence
  Synthetic oligonucleotide
ctgctgcataaactcgtggt

SEQ ID NO: 1339 - DNA, 18 bp, Artificial Sequence
  Synthetic oligonucleotide
cggaccaccaggtcagag

SEQ ID NO: 1340 - DNA, 24 bp, Artificial Sequence
  Synthetic oligonucleotide
ccactcttccctgctctgcgaatt

SEQ ID NO: 1341 - DNA, 20 bp, Artificial Sequence
  Synthetic oligonucleotide
caggggtagtgggtgttgag

SEQ ID NO: 1342 - DNA, 23 bp, Artificial Sequence
  Synthetic oligonucleotide
gcctttcttacccagaagcagaa

SEQ ID NO: 1343 - DNA, 30 bp, Artificial Sequence
  Synthetic oligonucleotide
tctcaaagtcgtcatccttcagttctccca

SEQ ID NO: 1344 - DNA, 19 bp, Artificial Sequence
  Synthetic oligonucleotide
cagcccccagctcactgat

SEQ ID NO: 1345 - DNA, 20 bp, Artificial Sequence
  Synthetic oligonucleotide
ggttggcatcaaaaggaact

SEQ ID NO: 1346 - DNA, 26 bp, Artificial Sequence
  Synthetic oligonucleotide
aattgtccctgaaactctcctgcacc

SEQ ID NO: 1347 - DNA, 20 bp, Artificial Sequence
  Synthetic oligonucleotide
tgccataaatgcaattgtcc

SEQ ID NO: 1348 - DNA, 23 bp, Artificial Sequence
  Synthetic oligonucleotide
tgagtggaaaagcctgacctatg

SEQ ID NO: 1349 - DNA, 27 bp, Artificial Sequence
  Synthetic oligonucleotide
tgaagtcatcagctttgtgccaccacc

SEQ ID NO: 1350 - DNA, 23 bp, Artificial Sequence
  Synthetic oligonucleotide
ggactccatctcttcttggtcaa

SEQ ID NO: 1351 - DNA, 23 bp, Artificial Sequence
  Synthetic oligonucleotide
cagatggccactttgagaacatt

SEQ ID NO: 1352 - DNA, 28 bp, Artificial Sequence
  Synthetic oligonucleotide
agctgacaacagtgtgaacgaccagacc

SEQ ID NO: 1353 - DNA, 22 bp, Artificial Sequence
  Synthetic oligonucleotide
ggcagcattaaccacaaggatt

SEQ ID NO: 1354 - DNA, 21 bp, Artificial Sequence
  Synthetic oligonucleotide
caaacgggctcatcataatgc

SEQ ID NO: 1355 - DNA, 27 bp, Artificial Sequence
  Synthetic oligonucleotide
tgatgtggtccctacgttttcgttcca

SEQ ID NO: 1356 - DNA, 20 bp, Artificial Sequence
  Synthetic oligonucleotide
tcccgcaaactgtgaaagct

SEQ ID NO: 1357 - DNA, 21 bp, Artificial Sequence
  Synthetic oligonucleotide
gacttttgcccgctacctttc

SEQ ID NO: 1358 - DNA, 24 bp, Artificial Sequence
  Synthetic oligonucleotide
acagctcattgttgtcacgccgga

SEQ ID NO: 1359 - DNA, 26 bp, Artificial Sequence
  Synthetic oligonucleotide
gccactaactgcttcagtatgaagag

SEQ ID NO: 1360 - DNA, 20 bp, Artificial Sequence
  Synthetic oligonucleotide
ggagaacaatccccttgaga

SEQ ID NO: 1361 - DNA, 27 bp, Artificial Sequence
  Synthetic oligonucleotide
tggcctttctgtctacaaggatcacca

SEQ ID NO: 1362 - DNA, 20 bp, Artificial Sequence
  Synthetic oligonucleotide
atctcctggatggtgatggt

SEQ ID NO: 1363 - DNA, 24 bp, Artificial Sequence
  Synthetic oligonucleotide
tgatggtcctatgtgtcacattca

SEQ ID NO: 1364 - DNA, 30 bp, Artificial Sequence
  Synthetic oligonucleotide
caggtttcataccaacacaggcttcagcac

SEQ ID NO: 1365 - DNA, 20 bp, Artificial Sequence
  Synthetic oligonucleotide
tgggacaggaaacacaccaa

SEQ ID NO: 1366 - DNA, 19 bp, Artificial Sequence
  Synthetic oligonucleotide
cgctcagccagatgcaatc

SEQ ID NO: 1367 - DNA, 21 bp, Artificial Sequence
  Synthetic oligonucleotide
tgccccagtcacctgctgtta

SEQ ID NO: 1368 - DNA, 25 bp, Artificial Sequence
  Synthetic oligonucleotide
gcactgagatcttcctattggtgaa

SEQ ID NO: 1369 - DNA, 19 bp, Artificial Sequence
  Synthetic oligonucleotide
ggagccgactgcaagtaca

SEQ ID NO: 1370 - DNA, 24 bp, Artificial Sequence
  Synthetic oligonucleotide
atcacacgcaccccagttctcaaa

SEQ ID NO: 1371 - DNA, 18 bp, Artificial Sequence
  Synthetic oligonucleotide
gactttggtgcctgtgcc

SEQ ID NO: 1372 - DNA, 19 bp, Artificial Sequence
  Synthetic oligonucleotide
ctacagggacgccatcgaa

SEQ ID NO: 1373 - DNA, 23 bp, Artificial Sequence
  Synthetic oligonucleotide
cttacaccagcatcaagatccgg

SEQ ID NO: 1374 - DNA, 23 bp, Artificial Sequence
  Synthetic oligonucleotide
atccaaccaatcacctgaatgtt

SEQ ID NO: 1375 - DNA, 20 bp, Artificial Sequence
  Synthetic oligonucleotide
ggagtcgaaggtggacaatc

SEQ ID NO: 1376 - DNA, 24 bp, Artificial Sequence
  Synthetic oligonucleotide
aatggcaccggaacaaactcaacc

SEQ ID NO: 1377 - DNA, 21 bp, Artificial Sequence
  Synthetic oligonucleotide
tgggaacagctgtagtggagt

SEQ ID NO: 1378 - DNA, 20 bp, Artificial Sequence
  Synthetic oligonucleotide
gtgaaatgaaacgcaccaca

SEQ ID NO: 1379 - DNA, 20 bp, Artificial Sequence
  Synthetic oligonucleotide
cagccctttggggaagctgg

SEQ ID NO: 1380 - DNA, 20 bp, Artificial Sequence
  Synthetic oligonucleotide
gaccctgctcacaaccagac

SEQ ID NO: 1381 - DNA, 21 bp, Artificial Sequence
  Synthetic oligonucleotide
acggatctaccacaccattgc

SEQ ID NO: 1382 - DNA, 22 bp, Artificial Sequence
  Synthetic oligonucleotide
tttgacaccccttccccagcca

SEQ ID NO: 1383 - DNA, 26 bp, Artificial Sequence
  Synthetic oligonucleotide
tccatatccaacaaaaaaactcaaag

SEQ ID NO: 1384 - DNA, 21 bp, Artificial Sequence
  Synthetic oligonucleotide
gggagatcatcgggacaactc

SEQ ID NO: 1385 - DNA, 30 bp, Artificial Sequence
  Synthetic oligonucleotide
agcaagatttcctccaggtccatcaaaagg

SEQ ID NO: 1386 - DNA, 19 bp, Artificial Sequence
  Synthetic oligonucleotide
gggcctggttgaaaagcat

SEQ ID NO: 1387 - DNA, 19 bp, Artificial Sequence
  Synthetic oligonucleotide
ccaacgcttgccaaatcct

SEQ ID NO: 1388 - DNA, 24 bp, Artificial Sequence
  Synthetic oligonucleotide
aaccagctctctgtgaccccaatt

SEQ ID NO: 1389 - DNA, 24 bp, Artificial Sequence
  Synthetic oligonucleotide
acggtagtgacagcatcaaaactc

SEQ ID NO: 1390 - DNA, 20 bp, Artificial Sequence
  Synthetic oligonucleotide
ccatgatggagaggcagaca

SEQ ID NO: 1391 - DNA, 24 bp, Artificial Sequence
  Synthetic oligonucleotide
ctgggagcatggcgatggataccc

SEQ ID NO: 1392 - DNA, 21 bp, Artificial Sequence
  Synthetic oligonucleotide
ggagtccgtccttaccgtcaa

SEQ ID NO: 1393 - DNA, 26 bp, Artificial Sequence
  Synthetic oligonucleotide
ggatggtagcagtctagggattaact

SEQ ID NO: 1394 - DNA, 28 bp, Artificial Sequence
  Synthetic oligonucleotide
cctgtatgctgcaactcatgaacttggc

SEQ ID NO: 1395 - DNA, 22 bp, Artificial Sequence
  Synthetic oligonucleotide
ggaatgtcccatacccaaagaa

SEQ ID NO: 1396 - DNA, 20 bp, Artificial Sequence
  Synthetic oligonucleotide
gagaaccaatctcaccgaca

SEQ ID NO: 1397 - DNA, 24 bp, Artificial Sequence
  Synthetic oligonucleotide
acaggtattcctctgccagctgcc

SEQ ID NO: 1398 - DNA, 20 bp, Artificial Sequence
  Synthetic oligonucleotide
cacccgagtgtaaccatagc

SEQ ID NO: 1399 - DNA, 18 bp, Artificial Sequence
  Synthetic oligonucleotide
tcatggtgcccgtcaatg

SEQ ID NO: 1400 - DNA, 29 bp, Artificial Sequence
  Synthetic oligonucleotide
acctgatacgtcttggtcttcatcgccat

SEQ ID NO: 1401 - DNA, 23 bp, Artificial Sequence
  Synthetic oligonucleotide
cgattgtctttgctcttcatgtg

SEQ ID NO: 1402 - DNA, 20 bp, Artificial Sequence
  Synthetic oligonucleotide
aggggatgacttggacacat

SEQ ID NO: 1403 - DNA, 25 bp, Artificial Sequence
  Synthetic oligonucleotide
ctgccattcgacatgactgcaattt

SEQ ID NO: 1404 - DNA, 20 bp, Artificial Sequence
  Synthetic oligonucleotide
aaaactgcatggctttgtca

SEQ ID NO: 1405 - DNA, 22 bp, Artificial Sequence
  Synthetic oligonucleotide
tcatcctggcgatctacttcct

SEQ ID NO: 1406 - DNA, 26 bp, Artificial Sequence
  Synthetic oligonucleotide
tctgtcctggctggagtcgctttcat

SEQ ID NO: 1407 - DNA, 20 bp, Artificial Sequence
  Synthetic oligonucleotide
ccgttgagtggaatcagcaa

SEQ ID NO: 1408 - DNA, 20 bp, Artificial Sequence
  Synthetic oligonucleotide
agcgcctggaatctacaact

SEQ ID NO: 1409 - DNA, 24 bp, Artificial Sequence
  Synthetic oligonucleotide
cggagtccagtgttttcccacttg

SEQ ID NO: 1410 - DNA, 20 bp, Artificial Sequence
  Synthetic oligonucleotide
agagcccctggagagaagat

SEQ ID NO: 1411 - DNA, 20 bp, Artificial Sequence
  Synthetic oligonucleotide
acttgcaggctgctatcctt

SEQ ID NO: 1412 - DNA, 25 bp, Artificial Sequence
  Synthetic oligonucleotide
ttcctactctcaggggcagcatgtt

SEQ ID NO: 1413 - DNA, 20 bp, Artificial Sequence
  Synthetic oligonucleotide
agcagacttgaaccctggtc

SEQ ID NO: 1414 - DNA, 20 bp, Artificial Sequence
  Synthetic oligonucleotide
gatgcagaattgaggcagac

SEQ ID NO: 1415 - DNA, 29 bp, Artificial Sequence
  Synthetic oligonucleotide
caagaagatttacttcgtcgattcccaga

SEQ ID NO: 1416 - DNA, 20 bp, Artificial Sequence
  Synthetic oligonucleotide
tcttggcaagtcggttaaga

SEQ ID NO: 1417 - DNA, 21 bp, Artificial Sequence
  Synthetic oligonucleotide
tgattaccatcatggctcaga

SEQ ID NO: 1418 - DNA, 24 bp, Artificial Sequence
  Synthetic oligonucleotide
tcccaattgtcgcttcttctgcag

SEQ ID NO: 1419 - DNA, 20 bp, Artificial Sequence
  Synthetic oligonucleotide
cttgtgaaaatgccatccac

SEQ ID NO: 1420 - DNA, 20 bp, Artificial Sequence
  Synthetic oligonucleotide
tctattgggggattggtagg

SEQ ID NO: 1421 - DNA, 26 bp, Artificial Sequence
  Synthetic oligonucleotide
ccgttaccagctggaaattcctgaga

SEQ ID NO: 1422 - DNA, 20 bp, Artificial Sequence
  Synthetic oligonucleotide
caaattgcgagtggtgaaat

SEQ ID NO: 1423 - DNA, 20 bp, Artificial Sequence
  Synthetic oligonucleotide
gtgtgagaagtgtgccaagg

SEQ ID NO: 1424 - DNA, 23 bp, Artificial Sequence
  Synthetic oligonucleotide
ctctccgcctttgcacacacagt

SEQ ID NO: 1425 - DNA, 20 bp, Artificial Sequence
  Synthetic oligonucleotide
ctgcacttctctgcttctgc

SEQ ID NO: 1426 - DNA, 19 bp, Artificial Sequence
  Synthetic oligonucleotide
ccgccctcacctgaagaga

SEQ ID NO: 1427 - DNA, 21 bp, Artificial Sequence
  Synthetic oligonucleotide
cccagtgtccgccaaggagcg

SEQ ID NO: 1428 - DNA, 22 bp, Artificial Sequence
  Synthetic oligonucleotide
ggaataagttagccgcgcttct

SEQ ID NO: 1429 - DNA, 20 bp, Artificial Sequence
  Synthetic oligonucleotide
ggccaggatctgtggtggta

SEQ ID NO: 1430 - DNA, 23 bp, Artificial Sequence
  Synthetic oligonucleotide
ctctggccttccgagaaggtacc

SEQ ID NO: 1431 - DNA, 20 bp, Artificial Sequence
  Synthetic oligonucleotide
ctccacgtcgtggacattga

SEQ ID NO: 1432 - DNA, 20 bp, Artificial Sequence
  Synthetic oligonucleotide
ctatgagccatgtgggaacc

SEQ ID NO: 1433 - DNA, 24 bp, Artificial Sequence
  Synthetic oligonucleotide
agcttcgagacctgcaggaccatc

SEQ ID NO: 1434 - DNA, 18 bp, Artificial Sequence
  Synthetic oligonucleotide
atgttggagtggatgccg

SEQ ID NO: 1435 - DNA, 19 bp, Artificial Sequence
  Synthetic oligonucleotide
tgcccttgcactgtcctaa

SEQ ID NO: 1436 - DNA, 24 bp, Artificial Sequence
  Synthetic oligonucleotide
tcagccatcctgcacacctacacc

SEQ ID NO: 1437 - DNA, 18 bp, Artificial Sequence
  Synthetic oligonucleotide
cagccacactcatccacg

SEQ ID NO: 1438 - DNA, 20 bp, Artificial Sequence
  Synthetic oligonucleotide
gtacgaccaagagaaacggg

SEQ ID NO: 1439 - DNA, 24 bp, Artificial Sequence
  Synthetic oligonucleotide
tctgcccgtcttctccatggtagg

SEQ ID NO: 1440 - DNA, 19 bp, Artificial Sequence
  Synthetic oligonucleotide
cctgtccaggtccatctca

SEQ ID NO: 1441 - DNA, 22 bp, Artificial Sequence
  Synthetic oligonucleotide
acgagaacgagggcatctatgt

SEQ ID NO: 1442 - DNA, 25 bp, Artificial Sequence
  Synthetic oligonucleotide
cgcacctttccggtcttgacatcct

SEQ ID NO: 1443 - DNA, 22 bp, Artificial Sequence
  Synthetic oligonucleotide
gcatgtaggtgcttccaatcac

SEQ ID NO: 1444 - DNA, 23 bp, Artificial Sequence
  Synthetic oligonucleotide
gaaggaatgggaatcagtcatga

SEQ ID NO: 1445 - DNA, 23 bp, Artificial Sequence
  Synthetic oligonucleotide
tcaccctggagatcagctcccga

SEQ ID NO: 1446 - DNA, 26 bp, Artificial Sequence
  Synthetic oligonucleotide
gtctattagagtcagatccgggacat

SEQ ID NO: 1447 - DNA, 20 bp, Artificial Sequence
  Synthetic oligonucleotide
agaaactggaggagcaggac

SEQ ID NO: 1448 - DNA, 24 bp, Artificial Sequence
  Synthetic oligonucleotide
tgcagctgctccttgatgctcagt

SEQ ID NO: 1449 - DNA, 20 bp, Artificial Sequence
  Synthetic oligonucleotide
cttcaggaaacgatgctcct

SEQ ID NO: 1450 - DNA, 18 bp, Artificial Sequence
  Synthetic oligonucleotide
gccgagatcgccaagatg

SEQ ID NO: 1451 - DNA, 24 bp, Artificial Sequence
  Synthetic oligonucleotide
cagcattgtctgtcctccctggca

SEQ ID NO: 1452 - DNA, 27 bp, Artificial Sequence
  Synthetic oligonucleotide
cttttgatggtagagttccagtgattc

SEQ ID NO: 1453 - DNA, 27 bp, Artificial Sequence
  Synthetic oligonucleotide
cggtacttctcagggctaatatatacg

SEQ ID NO: 1454 - DNA, 26 bp, Artificial Sequence
  Synthetic oligonucleotide
ctcttctgcgtggtggtcaaccccta

SEQ ID NO: 1455 - DNA, 21 bp, Artificial Sequence
  Synthetic oligonucleotide
ccgagtagatgggcaggtgtt

SEQ ID NO: 1456 - DNA, 19 bp, Artificial Sequence
  Synthetic oligonucleotide
tgacggagcgtgagtgcat

SEQ ID NO: 1457 - DNA, 25 bp, Artificial Sequence
  Synthetic oligonucleotide
ccctccgagatctgccgcatgtact

SEQ ID NO: 1458 - DNA, 21 bp, Artificial Sequence
  Synthetic oligonucleotide
atgccctgcttgtggatgtac

SEQ ID NO: 1459 - DNA, 25 bp, Artificial Sequence
  Synthetic oligonucleotide
taactgacattcttgagcaccagat

SEQ ID NO: 1460 - DNA, 28 bp, Artificial Sequence
  Synthetic oligonucleotide
cgggctgttccctttgagaaccttaaca

SEQ ID NO: 1461 - DNA, 18 bp, Artificial Sequence
  Synthetic oligonucleotide
atggcttgcccacaatgc

SEQ ID NO: 1462 - DNA, 19 bp, Artificial Sequence
  Synthetic oligonucleotide
ctctcccagcacagcttga

SEQ ID NO: 1463 - DNA, 24 bp, Artificial Sequence
  Synthetic oligonucleotide
cctcactgagtcaaccagcctgga

SEQ ID NO: 1464 - DNA, 20 bp, Artificial Sequence
  Synthetic oligonucleotide
caccagtgtcatccagcaac

SEQ ID NO: 1465 - DNA, 20 bp, Artificial Sequence
  Synthetic oligonucleotide
tagttcccagctgaccatca

SEQ ID NO: 1466 - DNA, 25 bp, Artificial Sequence
  Synthetic oligonucleotide
ctcagcctcgtcgttcttatccacc

SEQ ID NO: 1467 - DNA, 20 bp, Artificial Sequence
  Synthetic oligonucleotide
cagccttgttctcagcaatg

SEQ ID NO: 1468 - DNA, 18 bp, Artificial Sequence
  Synthetic oligonucleotide
ctactgcggaaagtcggg

SEQ ID NO: 1469 - DNA, 24 bp, Artificial Sequence
  Synthetic oligonucleotide
ctggagtccaaactcgcttcctgc

SEQ ID NO: 1470 - DNA, 21 bp, Artificial Sequence
  Synthetic oligonucleotide
ggactgatcgtacacgaggtt

SEQ ID NO: 1471 - DNA, 18 bp, Artificial Sequence
  Synthetic oligonucleotide
agggcaacattccacagc

SEQ ID NO: 1472 - DNA, 24 bp, Artificial Sequence
  Synthetic oligonucleotide
ctgcaaggacactcatcacagcca

SEQ ID NO: 1473 - DNA, 18 bp, Artificial Sequence
  Synthetic oligonucleotide
cagtgctcctactccggc

SEQ ID NO: 1474 - DNA, 19 bp, Artificial Sequence
  Synthetic oligonucleotide
tatccatcctgatggcgtc

SEQ ID NO: 1475 - DNA, 24 bp, Artificial Sequence
  Synthetic oligonucleotide
cccagtgctgactttcctcaggga

SEQ ID NO: 1476 - DNA, 20 bp, Artificial Sequence
  Synthetic oligonucleotide
ttgaactgtgcattggtgtg

SEQ ID NO: 1477 - DNA, 21 bp, Artificial Sequence
  Synthetic oligonucleotide
tgctggctactgggtgttagt

SEQ ID NO: 1478 - DNA, 24 bp, Artificial Sequence
  Synthetic oligonucleotide
tgcagtcctgtgtgcttccctctc

SEQ ID NO: 1479 - DNA, 20 bp, Artificial Sequence
  Synthetic oligonucleotide
gacaaccagggacacagtca

SEQ ID NO: 1480 - DNA, 18 bp, Artificial Sequence
  Synthetic oligonucleotide
gtgaggcagcgcgactct

SEQ ID NO: 1481 - DNA, 21 bp, Artificial Sequence
  Synthetic oligonucleotide
tgccttcccgggctgaggact

SEQ ID NO: 1482 - DNA, 23 bp, Artificial Sequence
  Synthetic oligonucleotide
tgccaatggtgtacaacacttca

SEQ ID NO: 1483 - DNA, 20 bp, Artificial Sequence
  Synthetic oligonucleotide
actccagagctgacctccac

SEQ ID NO: 1484 - DNA, 24 bp, Artificial Sequence
  Synthetic oligonucleotide
ctacaatgacttcccaggctgggc

SEQ ID NO: 1485 - DNA, 20 bp, Artificial Sequence
  Synthetic oligonucleotide
tcagggcttcagtgtctcac

SEQ ID NO: 1486 - DNA, 20 bp, Artificial Sequence
  Synthetic oligonucleotide
cagaccaaggagatggacct

SEQ ID NO: 1487 - DNA, 24 bp, Artificial Sequence
  Synthetic oligonucleotide
aagctgtaaacatgagccgcacca

SEQ ID NO: 1488 - DNA, 18 bp, Artificial Sequence
  Synthetic oligonucleotide
agctgccagtgctatccg

SEQ ID NO: 1489 - DNA, 19 bp, Artificial Sequence
  Synthetic oligonucleotide
ctgccgggatggcttctat

SEQ ID NO: 1490 - DNA, 21 bp, Artificial Sequence
  Synthetic oligonucleotide
ctgagctctgcccggaccgct

SEQ ID NO: 1491 - DNA, 22 bp, Artificial Sequence
  Synthetic oligonucleotide
ccaggttctggaaactgtggat

SEQ ID NO: 1492 - DNA, 22 bp, Artificial Sequence
  Synthetic oligonucleotide
ccaaggaatcatgttcgttcag

SEQ ID NO: 1493 - DNA, 22 bp, Artificial Sequence
  Synthetic oligonucleotide
tggccagcagcctctcgtccac

SEQ ID NO: 1494 - DNA, 20 bp, Artificial Sequence
  Synthetic oligonucleotide
tggtgctcgggagtcagact

SEQ ID NO: 1495 - DNA, 20 bp, Artificial Sequence
  Synthetic oligonucleotide
gagagagtgagcgaaccctg

SEQ ID NO: 1496 - DNA, 24 bp, Artificial Sequence
  Synthetic oligonucleotide
ccaggctccaagaagcagctgaag

SEQ ID NO: 1497 - DNA, 18 bp, Artificial Sequence
  Synthetic oligonucleotide
cgtcgcactggagctctt

SEQ ID NO: 1498 - DNA, 21 bp, Artificial Sequence
  Synthetic oligonucleotide
ggctgctggtacaaatactgc

SEQ ID NO: 1499 - DNA, 29 bp, Artificial Sequence
  Synthetic oligonucleotide
tgtctgcccctattattggtgtcatttct

SEQ ID NO: 1500 - DNA, 20 bp, Artificial Sequence
  Synthetic oligonucleotide
caatctaagccacgctgttg

SEQ ID NO: 1501 - DNA, 20 bp, Artificial Sequence
  Synthetic oligonucleotide
tgatccatctctaggccaca

SEQ ID NO: 1502 - DNA, 24 bp, Artificial Sequence
  Synthetic oligonucleotide
ttgtcaccttagttgcccgggttc

SEQ ID NO: 1503 - DNA, 20 bp, Artificial Sequence
  Synthetic oligonucleotide
gagcaaatgggttgacacaa

SEQ ID NO: 1504 - DNA, 19 bp, Artificial Sequence
  Synthetic oligonucleotide
ccaaccctgcagactccaa

SEQ ID NO: 1505 - DNA, 25 bp, Artificial Sequence
  Synthetic oligonucleotide
cctgggaccatccgtggagacttct

SEQ ID NO: 1506 - DNA, 28 bp, Artificial Sequence
  Synthetic oligonucleotide
atgtataatgttcctgccaacttgtatg

SEQ ID NO: 1507 - DNA, 18 bp, Artificial Sequence
  Synthetic oligonucleotide
atctccgcctcgctcatg

SEQ ID NO: 1508 - DNA, 22 bp, Artificial Sequence
  Synthetic oligonucleotide
ttcactcgcttcgccatcaccg

SEQ ID NO: 1509 - DNA, 21 bp, Artificial Sequence
  Synthetic oligonucleotide
tcggagccatacaggattgtc

SEQ ID NO: 1510 - DNA, 20 bp, Artificial Sequence
  Synthetic oligonucleotide
cgggtccaccagtttgaatg

SEQ ID NO: 1511 - DNA, 19 bp, Artificial Sequence
  Synthetic oligonucleotide
ccgctctgcagccgggaca

SEQ ID NO: 1512 - DNA, 21 bp, Artificial Sequence
  Synthetic oligonucleotide
gttgtattggttcggcaccat

SEQ ID NO: 1513 - DNA, 20 bp, Artificial Sequence
  Synthetic oligonucleotide
cacttccctgctgggattat

SEQ ID NO: 1514 - DNA, 24 bp, Artificial Sequence
  Synthetic oligonucleotide
ccgtgttgcacagctcatcacact

SEQ ID NO: 1515 - DNA, 20 bp, Artificial Sequence
  Synthetic oligonucleotide
agttgtcaaacaggcactcg

SEQ ID NO: 1516 - DNA, 22 bp, Artificial Sequence
  Synthetic oligonucleotide
aatgttgtccaggttctattgc

SEQ ID NO: 1517 - DNA, 28 bp, Artificial Sequence
  Synthetic oligonucleotide
aacaggcattttggacaacacattcttg

SEQ ID NO: 1518 - DNA, 19 bp, Artificial Sequence
  Synthetic oligonucleotide
caagcaaagggtggagttc

SEQ ID NO: 1519 - DNA, 21 bp, Artificial Sequence
  Synthetic oligonucleotide
cacagcttgcttgtcgatgtc

SEQ ID NO: 1520 - DNA, 21 bp, Artificial Sequence
  Synthetic oligonucleotide
ccttcgcctgcctctctgccc

SEQ ID NO: 1521 - DNA, 18 bp, Artificial Sequence
  Synthetic oligonucleotide
atgccggtcggtgatgag

SEQ ID NO: 1522 - DNA, 27 bp, Artificial Sequence
  Synthetic oligonucleotide
cgagactctcctcatagtgaaaggtat

SEQ ID NO: 1523 - DNA, 24 bp, Artificial Sequence
  Synthetic oligonucleotide
atgaccaccccggctcgtatgtca

SEQ ID NO: 1524 - DNA, 22 bp, Artificial Sequence
  Synthetic oligonucleotide
cttggcgtgtggaaatctacag

SEQ ID NO: 1525 - DNA, 20 bp, Artificial Sequence
  Synthetic oligonucleotide
cagctctctccacgcgattc

SEQ ID NO: 1526 - DNA, 28 bp, Artificial Sequence
  Synthetic oligonucleotide
caggatctaccccgagagagccactcat

SEQ ID NO: 1527 - DNA, 19 bp, Artificial Sequence
  Synthetic oligonucleotide
cccagcagctccattctga

SEQ ID NO: 1528 - DNA, 20 bp, Artificial Sequence
  Synthetic oligonucleotide
ctacagcctaaacggcaagg

SEQ ID NO: 1529 - DNA, 20 bp, Artificial Sequence
  Synthetic oligonucleotide
aggaccccaggacccagcag

SEQ ID NO: 1530 - DNA, 20 bp, Artificial Sequence
  Synthetic oligonucleotide
gttcccttcgaacagctttg

SEQ ID NO: 1531 - DNA, 20 bp, Artificial Sequence
  Synthetic oligonucleotide
agaaggactatgccgtccag

SEQ ID NO: 1532 - DNA, 24 bp, Artificial Sequence
  Synthetic oligonucleotide
atccacatcctgaaggcggacaag

SEQ ID NO: 1533 - DNA, 19 bp, Artificial Sequence
  Synthetic oligonucleotide
ccgtgaacttccaccagtc

SEQ ID NO: 1534 - DNA, 20 bp, Artificial Sequence
  Synthetic oligonucleotide
gcttccacatcgtggtattg

SEQ ID NO: 1535 - DNA, 27 bp, Artificial Sequence
  Synthetic oligonucleotide
cttctgataggtttcctcggcatcaga

SEQ ID NO: 1536 - DNA, 20 bp, Artificial Sequence
  Synthetic oligonucleotide
aactgcagggttgaaggact

SEQ ID NO: 1537 - DNA, 21 bp, Artificial Sequence
  Synthetic oligonucleotide
agagatcaccggcgtaatcaa

SEQ ID NO: 1538 - DNA, 27 bp, Artificial Sequence
  Synthetic oligonucleotide
ccagcgttggacaaatactttccgtca

SEQ ID NO: 1539 - DNA, 21 bp, Artificial Sequence
  Synthetic oligonucleotide
cgggctcagctatgattctca

SEQ ID NO: 1540 - DNA, 23 bp, Artificial Sequence
  Synthetic oligonucleotide
caaccgaagttttcactccagtt

SEQ ID NO: 1541 - DNA, 28 bp, Artificial Sequence
  Synthetic oligonucleotide
tccccacagtagacacatatgatggccg

SEQ ID NO: 1542 - DNA, 25 bp, Artificial Sequence
  Synthetic oligonucleotide
cctcagtccataaaccacactatca

SEQ ID NO: 1543 - DNA, 19 bp, Artificial Sequence
  Synthetic oligonucleotide
tccttgaccataccggagg

SEQ ID NO: 1544 - DNA, 24 bp, Artificial Sequence
  Synthetic oligonucleotide
tgcatgtacatctccggtgtccct

SEQ ID NO: 1545 - DNA, 20 bp, Artificial Sequence
  Synthetic oligonucleotide
cagtggcagtcttccctgtc

SEQ ID NO: 1546 - DNA, 20 bp, Artificial Sequence
  Synthetic oligonucleotide
gtttctgaaggggaggtcac

SEQ ID NO: 1547 - DNA, 24 bp, Artificial Sequence
  Synthetic oligonucleotide
ctgagctggcctcctatgcctcat

SEQ ID NO: 1548 - DNA, 19 bp, Artificial Sequence
  Synthetic oligonucleotide
aggtgtctggtttgggaca

SEQ ID NO: 1549 - DNA, 20 bp, Artificial Sequence
  Synthetic oligonucleotide
gctcatcatggtcatgtgct

SEQ ID NO: 1550 - DNA, 28 bp, Artificial Sequence
  Synthetic oligonucleotide
caggtctccttgatccactgacttttca

SEQ ID NO: 1551 - DNA, 20 bp, Artificial Sequence
  Synthetic oligonucleotide
tgtaagggtcagggatgtca

SEQ ID NO: 1552 - DNA, 19 bp, Artificial Sequence
  Synthetic oligonucleotide
ccctcgtgctgatgctact

SEQ ID NO: 1553 - DNA, 22 bp, Artificial Sequence
  Synthetic oligonucleotide
ctgccctagacgctggctcctc

SEQ ID NO: 1554 - DNA, 22 bp, Artificial Sequence
  Synthetic oligonucleotide
catcatgacctggtcttctagg

SEQ ID NO: 1555 - DNA, 19 bp, Artificial Sequence
  Synthetic oligonucleotide
gcggaaggtccctcagaca

SEQ ID NO: 1556 - DNA, 29 bp, Artificial Sequence
  Synthetic oligonucleotide
ctcagagcctctctggttctttcaatcgg

SEQ ID NO: 1557 - DNA, 24 bp, Artificial Sequence
  Synthetic oligonucleotide
tgatgatctaagtttcccgaggtt

SEQ ID NO: 1558 - DNA, 21 bp, Artificial Sequence
  Synthetic oligonucleotide
tggagactctcagggtcgaaa

SEQ ID NO: 1559 - DNA, 20 bp, Artificial Sequence
  Synthetic oligonucleotide
cggcggcagaccagcatgac

SEQ ID NO: 1560 - DNA, 22 bp, Artificial Sequence
  Synthetic oligonucleotide
ggcgtttggagtggtagaaatc

SEQ ID NO: 1561 - DNA, 21 bp, Artificial Sequence
  Synthetic oligonucleotide
cggtggaccacgaagagttaa

SEQ ID NO: 1562 - DNA, 23 bp, Artificial Sequence
  Synthetic oligonucleotide
ccgggacttggagaagcactgca

SEQ ID NO: 1563 - DNA, 19 bp, Artificial Sequence
  Synthetic oligonucleotide
ggctcgcctcttccatgtc

SEQ ID NO: 1564 - DNA, 20 bp, Artificial Sequence
  Synthetic oligonucleotide
ctttgaacccttgcttgcaa

SEQ ID NO: 1565 - DNA, 25 bp, Artificial Sequence
  Synthetic oligonucleotide
aagtcctgggtgcttctgacgcaca

SEQ ID NO: 1566 - DNA, 18 bp, Artificial Sequence
  Synthetic oligonucleotide
cccgggacaaagcaaatg

SEQ ID NO: 1567 - DNA, 20 bp, Artificial Sequence
  Synthetic oligonucleotide
cccagctagtgttcctcaga

SEQ ID NO: 1568 - DNA, 24 bp, Artificial Sequence
  Synthetic oligonucleotide
tcggccagctttttccaatctttg

SEQ ID NO: 1569 - DNA, 20 bp, Artificial Sequence
  Synthetic oligonucleotide
ccgtaagcccttcctctatg

SEQ ID NO: 1570 - DNA, 20 bp, Artificial Sequence
  Synthetic oligonucleotide
agcagtggcttgctttcttc

SEQ ID NO: 1571 - DNA, 25 bp, Artificial Sequence
  Synthetic oligonucleotide
cctgtgatgtcccagtttcccactc

SEQ ID NO: 1572 - DNA, 20 bp, Artificial Sequence
  Synthetic oligonucleotide
tgctaggaccatgttgggat

SEQ ID NO: 1573 - DNA, 19 bp, Artificial Sequence
  Synthetic oligonucleotide
ccgcaacgtggttttctca

SEQ ID NO: 1574 - DNA, 22 bp, Artificial Sequence
  Synthetic oligonucleotide
ctcggtgttggccatgctccag

SEQ ID NO: 1575 - DNA, 21 bp, Artificial Sequence
  Synthetic oligonucleotide
tgctgggtttctcctcctgtt

SEQ ID NO: 1576 - DNA, 20 bp, Artificial Sequence
  Synthetic oligonucleotide
gagctgtgggttgttatgga

SEQ ID NO: 1577 - DNA, 24 bp, Artificial Sequence
  Synthetic oligonucleotide
acatctgtcaaggagcctccagcc

SEQ ID NO: 1578 - DNA, 20 bp, Artificial Sequence
  Synthetic oligonucleotide
ccatgcaagtttctgtcacc

SEQ ID NO: 1579 - DNA, 20 bp, Artificial Sequence
  Synthetic oligonucleotide
ggagctgacctgcttcctac

SEQ ID NO: 1580 - DNA, 22 bp, Artificial Sequence
  Synthetic oligonucleotide
tccttatgcatcgaggccaggc

SEQ ID NO: 1581 - DNA, 20 bp, Artificial Sequence
  Synthetic oligonucleotide
agcagagcaccacagcatag

SEQ ID NO: 1582 - DNA, 20 bp, Artificial Sequence
  Synthetic oligonucleotide
aggtggctgtgttactgcaa

SEQ ID NO: 1583 - DNA, 25 bp, Artificial Sequence
  Synthetic oligonucleotide
tgccacagttctgcgacagtctacc

SEQ ID NO: 1584 - DNA, 20 bp, Artificial Sequence
  Synthetic oligonucleotide
cacctgtgtggtttcgtacc

SEQ ID NO: 1585 - DNA, 22 bp, Artificial Sequence
  Synthetic oligonucleotide
gaaggtgttggaggcactcaag

SEQ ID NO: 1586 - DNA, 24 bp, Artificial Sequence
  Synthetic oligonucleotide
atcccagcaggcctcgttgatgag

SEQ ID NO: 1587 - DNA, 21 bp, Artificial Sequence
  Synthetic oligonucleotide
ggtttacaccgctggagctaa

SEQ ID NO: 1588 - DNA, 19 bp, Artificial Sequence
  Synthetic oligonucleotide
ttgttggtgtgccctggtg

SEQ ID NO: 1589 - DNA, 22 bp, Artificial Sequence
  Synthetic oligonucleotide
tggtggcggtcactccctctgc

SEQ ID NO: 1590 - DNA, 21 bp, Artificial Sequence
  Synthetic oligonucleotide
tgggttctgtccaaacactgg

SEQ ID NO: 1591 - DNA, 20 bp, Artificial Sequence
  Synthetic oligonucleotide
actgaaggagacccttggag

SEQ ID NO: 1592 - DNA, 21 bp, Artificial Sequence
  Synthetic oligonucleotide
tctcctgccgatgcccctagg

SEQ ID NO: 1593 - DNA, 20 bp, Artificial Sequence
  Synthetic oligonucleotide
taaataaccctgcccacaca

SEQ ID NO: 1594 - DNA, 28 bp, Artificial Sequence
  Synthetic oligonucleotide
agttactaaaaaataccacgaggtcctt

SEQ ID NO: 1595 - DNA, 27 bp, Artificial Sequence
  Synthetic oligonucleotide
ccctgacaccggtctttggtctcaact

SEQ ID NO: 1596 - DNA, 21 bp, Artificial Sequence
  Synthetic oligonucleotide
gtcggtgagtgatttgtgcaa

SEQ ID NO: 1597 - DNA, 20 bp, Artificial Sequence
  Synthetic oligonucleotide
tatcgaggcaggtcatacca

SEQ ID NO: 1598 - DNA, 25 bp, Artificial Sequence
  Synthetic oligonucleotide
tccaggtcaacttttgacttccggt

SEQ ID NO: 1599 - DNA, 20 bp, Artificial Sequence
  Synthetic oligonucleotide
taacgcttggcatcatcatt

SEQ ID NO: 1600 - DNA, 20 bp, Artificial Sequence
  Synthetic oligonucleotide
gggagtttccaagagatgga

SEQ ID NO: 1601 - DNA, 23 bp, Artificial Sequence
  Synthetic oligonucleotide
cccaagacccgaccaagcactag

SEQ ID NO: 1602 - DNA, 20 bp, Artificial Sequence
  Synthetic oligonucleotide
cttcaaccaccttcccaaac

SEQ ID NO: 1603 - DNA, 20 bp, Artificial Sequence
  Synthetic oligonucleotide
ccagctctccttccagctac

SEQ ID NO: 1604 - DNA, 24 bp, Artificial Sequence
  Synthetic oligonucleotide
atcaatgtccctgtccgagtgctg

SEQ ID NO: 1605 - DNA, 20 bp, Artificial Sequence
  Synthetic oligonucleotide
gggtggctctcacttagctc

SEQ ID NO: 1606 - DNA, 20 bp, Artificial Sequence
  Synthetic oligonucleotide
ggaaaacgttcgtcaacatc

SEQ ID NO: 1607 - DNA, 23 bp, Artificial Sequence
  Synthetic oligonucleotide
caaccaggacacccacctcagct

SEQ ID NO: 1608 - DNA, 20 bp, Artificial Sequence
  Synthetic oligonucleotide
aaaacttgaccggtctttgc

SEQ ID NO: 1609 - DNA, 22 bp, Artificial Sequence
  Synthetic oligonucleotide
tctatacgtcgatggtgactgc

SEQ ID NO: 1610 - DNA, 24 bp, Artificial Sequence
  Synthetic oligonucleotide
ctccccaccttgactctttgtccg

SEQ ID NO: 1611 - DNA, 19 bp, Artificial Sequence
  Synthetic oligonucleotide
gccgacagccacattgtat

SEQ ID NO: 1612 - DNA, 24 bp, Artificial Sequence
  Synthetic oligonucleotide
agagccagttgctgtagaactcaa

SEQ ID NO: 1613 - DNA, 27 bp, Artificial Sequence
  Synthetic oligonucleotide
tctctgctgggcaaggatgttctgttc

SEQ ID NO: 1614 - DNA, 21 bp, Artificial Sequence
  Synthetic oligonucleotide
ctgggcctacacagtccttca

SEQ ID NO: 1615 - DNA, 18 bp, Artificial Sequence
  Synthetic oligonucleotide
tgctacctggacagcccg

SEQ ID NO: 1616 - DNA, 28 bp, Artificial Sequence
  Synthetic oligonucleotide
tcctcctgaaacgagctgtgtctgactt

SEQ ID NO: 1617 - DNA, 20 bp, Artificial Sequence
  Synthetic oligonucleotide
aggccgtccttcagtaacca

SEQ ID NO: 1618 - DNA, 21 bp, Artificial Sequence
  Synthetic oligonucleotide
ataccaatcaccgcacaaacc

SEQ ID NO: 1619 - DNA, 30 bp, Artificial Sequence
  Synthetic oligonucleotide
tgcgctgtgactggacttaacaaatagcct

SEQ ID NO: 1620 - DNA, 23 bp, Artificial Sequence
  Synthetic oligonucleotide
cacactagcattttctccgcata

SEQ ID NO: 1621 - DNA, 20 bp, Artificial Sequence
  Synthetic oligonucleotide
gtgattgaagagcatgccaa

SEQ ID NO: 1622 - DNA, 24 bp, Artificial Sequence
  Synthetic oligonucleotide
tcctgcttctcgggatacagacca

SEQ ID NO: 1623 - DNA, 18 bp, Artificial Sequence
  Synthetic oligonucleotide
gtcctgcgtgggaatagc

SEQ ID NO: 1624 - DNA, 20 bp, Artificial Sequence
  Synthetic oligonucleotide
ctgctcaaggacaccgtcta

SEQ ID NO: 1625 - DNA, 24 bp, Artificial Sequence
  Synthetic oligonucleotide
tacactcgggtcccatcgaagtcc

SEQ ID NO: 1626 - DNA, 18 bp, Artificial Sequence
  Synthetic oligonucleotide
ggatccactctggagggc

SEQ ID NO: 1627 - DNA, 20 bp, Artificial Sequence
  Synthetic oligonucleotide
gatcaacggctacatccaga

SEQ ID NO: 1628 - DNA, 25 bp, Artificial Sequence
  Synthetic oligonucleotide
tcaaagtcctcctctcccgacttga

SEQ ID NO: 1629 - DNA, 20 bp, Artificial Sequence
  Synthetic oligonucleotide
tgaactgtgaggccagagac

SEQ ID NO: 1630 - DNA, 19 bp, Artificial Sequence
  Synthetic oligonucleotide
cagcaccagcgattacgac

SEQ ID NO: 1631 - DNA, 24 bp, Artificial Sequence
  Synthetic oligonucleotide
agccattgtgaggactctcccagc

SEQ ID NO: 1632 - DNA, 18 bp, Artificial Sequence
  Synthetic oligonucleotide
ctgaataggcccacgtcc

SEQ ID NO: 1633 - DNA, 20 bp, Artificial Sequence
  Synthetic oligonucleotide
ccgcctggacattgattcac

SEQ ID NO: 1634 - DNA, 23 bp, Artificial Sequence
  Synthetic oligonucleotide
acccatcacagcccggaacactg

SEQ ID NO: 1635 - DNA, 21 bp, Artificial Sequence
  Synthetic oligonucleotide
ctgggccaatggtacagatga

SEQ ID NO: 1636 - DNA, 19 bp, Artificial Sequence
  Synthetic oligonucleotide
gcatccctcacccatccta

SEQ ID NO: 1637 - DNA, 24 bp, Artificial Sequence
  Synthetic oligonucleotide
aggccaggcaggagcccttctata

SEQ ID NO: 1638 - DNA, 20 bp, Artificial Sequence
  Synthetic oligonucleotide
gctggaaatctgctggatgt

SEQ ID NO: 1639 - DNA, 20 bp, Artificial Sequence
  Synthetic oligonucleotide
cccatggatgctcctctgaa

SEQ ID NO: 1640 - DNA, 22 bp, Artificial Sequence
  Synthetic oligonucleotide
cattgactgccgaggccccatg

SEQ ID NO: 1641 - DNA, 20 bp, Artificial Sequence
  Synthetic oligonucleotide
ccggtggctaccagacattg

SEQ ID NO: 1642 - DNA, 26 bp, Artificial Sequence
  Synthetic oligonucleotide
aatgaatacagtattcccaagcacat

SEQ ID NO: 1643 - DNA, 18 bp, Artificial Sequence
  Synthetic oligonucleotide
aaccccgtggccgcctcc

SEQ ID NO: 1644 - DNA, 23 bp, Artificial Sequence
  Synthetic oligonucleotide
tgtctgaagcatcttctggatga

SEQ ID NO: 1645 - DNA, 19 bp, Artificial Sequence
  Synthetic oligonucleotide
tgaaggagacgtaccgctg

SEQ ID NO: 1646 - DNA, 24 bp, Artificial Sequence
  Synthetic oligonucleotide
caagcaggttcactacacgctgcc

SEQ ID NO: 1647 - DNA, 18 bp, Artificial Sequence
  Synthetic oligonucleotide
caggcagtgagaggctgg

SEQ ID NO: 1648 - DNA, 19 bp, Artificial Sequence
  Synthetic oligonucleotide
cagggaggtggttgcaaat

SEQ ID NO: 1649 - DNA, 24 bp, Artificial Sequence
  Synthetic oligonucleotide
tccagccttttcgtggtgactcaa

SEQ ID NO: 1650 - DNA, 19 bp, Artificial Sequence
  Synthetic oligonucleotide
tctcccaggatgcatgaag

SEQ ID NO: 1651 - DNA, 21 bp, Artificial Sequence
  Synthetic oligonucleotide
cttacggttttcgtggagaag

SEQ ID NO: 1652 - DNA, 29 bp, Artificial Sequence
  Synthetic oligonucleotide
cctcagctatacaacaaattgaccccaag

SEQ ID NO: 1653 - DNA, 20 bp, Artificial Sequence
  Synthetic oligonucleotide
agcagccgttcttgttgtaa

SEQ ID NO: 1654 - DNA, 20 bp, Artificial Sequence
  Synthetic oligonucleotide
gatgtggactgccattcaaa

SEQ ID NO: 1655 - DNA, 28 bp, Artificial Sequence
  Synthetic oligonucleotide
tcgaaatttacatccggtatcttcctgg

SEQ ID NO: 1656 - DNA, 20 bp, Artificial Sequence
  Synthetic oligonucleotide
tgcgagattagttggctgag

SEQ ID NO: 1657 - DNA, 21 bp, Artificial Sequence
  Synthetic oligonucleotide
tgactttatggagcccaagtt

SEQ ID NO: 1658 - DNA, 25 bp, Artificial Sequence
  Synthetic oligonucleotide
ttccagtgcattgaacttcacagca

SEQ ID NO: 1659 - DNA, 20 bp, Artificial Sequence
  Synthetic oligonucleotide
gccaagtcgctgtcatctaa

SEQ ID NO: 1660 - DNA, 20 bp, Artificial Sequence
  Synthetic oligonucleotide
tcctcatttggatgggaaac

SEQ ID NO: 1661 - DNA, 29 bp, Artificial Sequence
  Synthetic oligonucleotide
ttcctttaattacttggccaaacaccaca

SEQ ID NO: 1662 - DNA, 21 bp, Artificial Sequence
  Synthetic oligonucleotide
ccaatatccttgccactccta

SEQ ID NO: 1663 - DNA, 18 bp, Artificial Sequence
  Synthetic oligonucleotide
gccatccgcaaaggcttt

SEQ ID NO: 1664 - DNA, 23 bp, Artificial Sequence
  Synthetic oligonucleotide
tcgcttgtcaccttgccatgtgg

SEQ ID NO: 1665 - DNA, 18 bp, Artificial Sequence
  Synthetic oligonucleotide
ggccattccgccagtttc

SEQ ID NO: 1666 - DNA, 20 bp, Artificial Sequence
  Synthetic oligonucleotide
ggctcagagcataaggcttc

SEQ ID NO: 1667 - DNA, 24 bp, Artificial Sequence
  Synthetic oligonucleotide
ttggtcacttctcccaacttgggc

SEQ ID NO: 1668 - DNA, 20 bp, Artificial Sequence
  Synthetic oligonucleotide
acgggaactcagaaaactgg

SEQ ID NO: 1669 - DNA, 20 bp, Artificial Sequence
  Synthetic oligonucleotide
gcatcaggctgtcattatgg

SEQ ID NO: 1670 - DNA, 28 bp, Artificial Sequence
  Synthetic oligonucleotide
tgtccttacctgtgggagctgtaaggtc

SEQ ID NO: 1671 - DNA, 20 bp, Artificial Sequence
  Synthetic oligonucleotide
agtagttgtgctgcccttcc

SEQ ID NO: 1672 - DNA, 20 bp, Artificial Sequence
  Synthetic oligonucleotide
ggtgtccttcgccagatcac

SEQ ID NO: 1673 - DNA, 26 bp, Artificial Sequence
  Synthetic oligonucleotide
ttaatgatttgcctgtgggacgctcc

SEQ ID NO: 1674 - DNA, 18 bp, Artificial Sequence
  Synthetic oligonucleotide
cagccgcagagcctcatc

SEQ ID NO: 1675 - DNA, 20 bp, Artificial Sequence
  Synthetic oligonucleotide
tgaccccaatggagtcatca

SEQ ID NO: 1676 - DNA, 27 bp, Artificial Sequence
  Synthetic oligonucleotide
catttgagcgtcaacgatctcccagtg

SEQ ID NO: 1677 - DNA, 19 bp, Artificial Sequence
  Synthetic oligonucleotide
ccaagcggagggtttcttc

SEQ ID NO: 1678 - DNA, 22 bp, Artificial Sequence
  Synthetic oligonucleotide
ttacccatttggcctggattaa

SEQ ID NO: 1679 - DNA, 26 bp, Artificial Sequence
  Synthetic oligonucleotide
ccaagtcctccttgtcttcgaggggt

SEQ ID NO: 1680 - DNA, 25 bp, Artificial Sequence
  Synthetic oligonucleotide
ctgaaagaagtggaatccttattgg

SEQ ID NO: 1681 - DNA, 20 bp, Artificial Sequence
  Synthetic oligonucleotide
ctgtgagccagaggatgtca

SEQ ID NO: 1682 - DNA, 24 bp, Artificial Sequence
  Synthetic oligonucleotide
ctgccaattgtgttttcctgcagc

SEQ ID NO: 1683 - DNA, 20 bp, Artificial Sequence
  Synthetic oligonucleotide
tgtgatgacaccaggatgtg

SEQ ID NO: 1684 - DNA, 21 bp, Artificial Sequence
  Synthetic oligonucleotide
caagcaatgcgtcatcaatgt

SEQ ID NO: 1685 - DNA, 25 bp, Artificial Sequence
  Synthetic oligonucleotide
cagcctctgcggaatggatcacact

SEQ ID NO: 1686 - DNA, 20 bp, Artificial Sequence
  Synthetic oligonucleotide
gtaaatccgccccctcttct

SEQ ID NO: 1687 - DNA, 18 bp, Artificial Sequence
  Synthetic oligonucleotide
gacccagctccactcctg

SEQ ID NO: 1688 - DNA, 24 bp, Artificial Sequence
  Synthetic oligonucleotide
ccagaccatggaccgcctgtactt

SEQ ID NO: 1689 - DNA, 20 bp, Artificial Sequence
  Synthetic oligonucleotide
cccattcacgtactccatca

SEQ ID NO: 1690 - DNA, 20 bp, Artificial Sequence
  Synthetic oligonucleotide
ctgacacttgccgcagagaa

SEQ ID NO: 1691 - DNA, 26 bp, Artificial Sequence
  Synthetic oligonucleotide
ccctttctcacccacctcatctgcac

SEQ ID NO: 1692 - DNA, 20 bp, Artificial Sequence
  Synthetic oligonucleotide
aggtggtccttggtctggaa

SEQ ID NO: 1693 - DNA, 21 bp, Artificial Sequence
  Synthetic oligonucleotide
gcgatacatgagcccagaaca

SEQ ID NO: 1694 - DNA, 29 bp, Artificial Sequence
  Synthetic oligonucleotide
aggtccacttcctttccatagtcttgcga

SEQ ID NO: 1695 - DNA, 22 bp, Artificial Sequence
  Synthetic oligonucleotide
tcagcaagaattagccccaaag

SEQ ID NO: 1696 - DNA, 19 bp, Artificial Sequence
  Synthetic oligonucleotide
gccctcccagtgtgcaaat

SEQ ID NO: 1697 - DNA, 23 bp, Artificial Sequence
  Synthetic oligonucleotide
tgctgtttcgacgacaccgttcg

SEQ ID NO: 1698 - DNA, 25 bp, Artificial Sequence
  Synthetic oligonucleotide
cgtcgatggtattaggatagaagca

SEQ ID NO: 1699 - DNA, 19 bp, Artificial Sequence
  Synthetic oligonucleotide
ccacgacaaagccgactac

SEQ ID NO: 1700 - DNA, 24 bp, Artificial Sequence
  Synthetic oligonucleotide
cctgaaacaaggctgagaatcccg

SEQ ID NO: 1701 - DNA, 19 bp, Artificial Sequence
  Synthetic oligonucleotide
tactcgatgggctctgctg

SEQ ID NO: 1702 - DNA, 25 bp, Artificial Sequence
  Synthetic oligonucleotide
tggctaagtgaagatgacaatcatg

SEQ ID NO: 1703 - DNA, 29 bp, Artificial Sequence
  Synthetic oligonucleotide
cctttccagctttacagtgaattgctgca

SEQ ID NO: 1704 - DNA, 25 bp, Artificial Sequence
  Synthetic oligonucleotide
tgcacatatcattacaccagttcgt

SEQ ID NO: 1705 - DNA, 20 bp, Artificial Sequence
  Synthetic oligonucleotide
taactggggcaaccttttct

SEQ ID NO: 1706 - DNA, 22 bp, Artificial Sequence
  Synthetic oligonucleotide
cctttgccttcctggggctctt

SEQ ID NO: 1707 - DNA, 20 bp, Artificial Sequence
  Synthetic oligonucleotide
ttgcaggaaaaggtgactgt

SEQ ID NO: 1708 - DNA, 22 bp, Artificial Sequence
  Synthetic oligonucleotide
agtgactgggagtgggctagaa

SEQ ID NO: 1709 - DNA, 24 bp, Artificial Sequence
  Synthetic oligonucleotide
tgacacctccacaacgtcgctgga

SEQ ID NO: 1710 - DNA, 21 bp, Artificial Sequence
  Synthetic oligonucleotide
aagcctgttaccgtgaatcga

SEQ ID NO: 1711 - DNA, 24 bp, Artificial Sequence
  Synthetic oligonucleotide
cgaggtacaagctgagatcaagaa

SEQ ID NO: 1712 - DNA, 22 bp, Artificial Sequence
  Synthetic oligonucleotide
ccagtgccagtgtccagcggct

SEQ ID NO: 1713 - DNA, 18 bp, Artificial Sequence
  Synthetic oligonucleotide
gcgtgcctttcgcttgaa

SEQ ID NO: 1714 - DNA, 20 bp, Artificial Sequence
  Synthetic oligonucleotide
gaccggtcgaatgataaggt

SEQ ID NO: 1715 - DNA, 24 bp, Artificial Sequence
  Synthetic oligonucleotide
accaggcccgtcacattctcgtac

SEQ ID NO: 1716 - DNA, 20 bp, Artificial Sequence
  Synthetic oligonucleotide
ctggacatctcgatgacagc

SEQ ID NO: 1717 - DNA, 19 bp, Artificial Sequence
  Synthetic oligonucleotide
caagcccagccgacctaag

SEQ ID NO: 1718 - DNA, 23 bp, Artificial Sequence
  Synthetic oligonucleotide
ctccgcaaaccaacctcctggct

SEQ ID NO: 1719 - DNA, 21 bp, Artificial Sequence
  Synthetic oligonucleotide
gaacctggaactgcagctttg

SEQ ID NO: 1720 - DNA, 20 bp, Artificial Sequence
  Synthetic oligonucleotide
cctgttctcggcaccttaaa

SEQ ID NO: 1721 - DNA, 24 bp, Artificial Sequence
  Synthetic oligonucleotide
acctgactgccccggggtctaata

SEQ ID NO: 1722 - DNA, 18 bp, Artificial Sequence
  Synthetic oligonucleotide
tattgccttcgggtgtcc

SEQ ID NO: 1723 - DNA, 20 bp, Artificial Sequence
  Synthetic oligonucleotide
aatatttgtgcggggtatgg

SEQ ID NO: 1724 - DNA, 29 bp, Artificial Sequence
  Synthetic oligonucleotide
ccaagagaaacgagatttaaaaacccacc

SEQ ID NO: 1725 - DNA, 20 bp, Artificial Sequence
  Synthetic oligonucleotide
aacgagatccctgtgcttgt

SEQ ID NO: 1726 - DNA, 23 bp, Artificial Sequence
  Synthetic oligonucleotide
cgcttgcctaactcatactttcc

SEQ ID NO: 1727 - DNA, 19 bp, Artificial Sequence
  Synthetic oligonucleotide
tccacgcagcgtggcactg

SEQ ID NO: 1728 - DNA, 20 bp, Artificial Sequence
  Synthetic oligonucleotide
ccattcagactgcgccactt

SEQ ID NO: 1729 - DNA, 20 bp, Artificial Sequence
  Synthetic oligonucleotide
aatgaggaagtttcggatgg

SEQ ID NO: 1730 - DNA, 23 bp, Artificial Sequence
  Synthetic oligonucleotide
ctgatccagacagccgaccagct

SEQ ID NO: 1731 - DNA, 20 bp, Artificial Sequence
  Synthetic oligonucleotide
cttcgatcacagccaggtag

SEQ ID NO: 1732 - DNA, 20 bp, Artificial Sequence
  Synthetic oligonucleotide
tgttttagctgagggacgtg

SEQ ID NO: 1733 - DNA, 24 bp, Artificial Sequence
  Synthetic oligonucleotide
ccgacgtccccaaacctagctagg

SEQ ID NO: 1734 - DNA, 20 bp, Artificial Sequence
  Synthetic oligonucleotide
taccaaccctggaatgttga

SEQ ID NO: 1735 - DNA, 21 bp, Artificial Sequence
  Synthetic oligonucleotide
aacttccggtacctcgttcgt

SEQ ID NO: 1736 - DNA, 29 bp, Artificial Sequence
  Synthetic oligonucleotide
actacatgaagcagagtcctcccgaatcg

SEQ ID NO: 1737 - DNA, 20 bp, Artificial Sequence
  Synthetic oligonucleotide
agcactgcaatgcaccagaa

SEQ ID NO: 1738 - DNA, 19 bp, Artificial Sequence
  Synthetic oligonucleotide
catggcctgatcatggtgt

SEQ ID NO: 1739 - DNA, 24 bp, Artificial Sequence
  Synthetic oligonucleotide
cccacagcaaatgctgcagaaagt

SEQ ID NO: 1740 - DNA, 21 bp, Artificial Sequence
  Synthetic oligonucleotide
ccatgtgtacaaactgcagga

SEQ ID NO: 1741 - DNA, 28 bp, Artificial Sequence
  Synthetic oligonucleotide
ggctactctgatctatgttgataaggaa

SEQ ID NO: 1742 - DNA, 22 bp, Artificial Sequence
  Synthetic oligonucleotide
cacacgggtgcctggttctcca

SEQ ID NO: 1743 - DNA, 20 bp, Artificial Sequence
  Synthetic oligonucleotide
gcttcagcccatccttagca

SEQ ID NO: 1744 - DNA, 18 bp, Artificial Sequence
  Synthetic oligonucleotide
cctgcagctgtgggacat

SEQ ID NO: 1745 - DNA, 24 bp, Artificial Sequence
  Synthetic oligonucleotide
cgatttggcaacatgacccgagta

SEQ ID NO: 1746 - DNA, 19 bp, Artificial Sequence
  Synthetic oligonucleotide
agcaccaacagcttccttg

SEQ ID NO: 1747 - DNA, 21 bp, Artificial Sequence
  Synthetic oligonucleotide
gcgacagctcctctagttcca

SEQ ID NO: 1748 - DNA, 19 bp, Artificial Sequence
  Synthetic oligonucleotide
ttcccgaagtctccgcccg

SEQ ID NO: 1749 - DNA, 22 bp, Artificial Sequence
  Synthetic oligonucleotide
ggaacaccagcttgaatttcct

SEQ ID NO: 1750 - DNA, 21 bp, Artificial Sequence
  Synthetic oligonucleotide
tgttgtaaatgtctcagcccc

SEQ ID NO: 1751 - DNA, 23 bp, Artificial Sequence
  Synthetic oligonucleotide
cgttcttggtcctgtcccttgga

SEQ ID NO: 1752 - DNA, 20 bp, Artificial Sequence
  Synthetic oligonucleotide
ttgagcaaagcgtacaaagg

SEQ ID NO: 1753 - DNA, 24 bp, Artificial Sequence
  Synthetic oligonucleotide
gaacttcttgagcaggagcatacc

SEQ ID NO: 1754 - DNA, 25 bp, Artificial Sequence
  Synthetic oligonucleotide
agggcttcataatcaccttctgttc

SEQ ID NO: 1755 - DNA, 25 bp, Artificial Sequence
  Synthetic oligonucleotide
tccacccccaagaatatcatctagt

SEQ ID NO: 1756 - DNA, 23 bp, Artificial Sequence
  Synthetic oligonucleotide
agctagcctcagtgacacacatg

SEQ ID NO: 1757 - DNA, 24 bp, Artificial Sequence
  Synthetic oligonucleotide
acacaacgtcggcagtgcaacctg

SEQ ID NO: 1758 - DNA, 18 bp, Artificial Sequence
  Synthetic oligonucleotide
ccggatctgacggctgtt

SEQ ID NO: 1759 - DNA, 20 bp, Artificial Sequence
  Synthetic oligonucleotide
cgtcgtatgcgagagtctgt

SEQ ID NO: 1760 - DNA, 26 bp, Artificial Sequence
  Synthetic oligonucleotide
tccaggatgcctgttagttctcagca

SEQ ID NO: 1761 - DNA, 20 bp, Artificial Sequence
  Synthetic oligonucleotide
tgaaggcgtgaggtgtagaa

SEQ ID NO: 1762 - DNA, 26 bp, Artificial Sequence
  Synthetic oligonucleotide
ggtgtcagatataaatgtgcaaatgc

SEQ ID NO: 1763 - DNA, 28 bp, Artificial Sequence
  Synthetic oligonucleotide
tgctgtcctgtcggtctcagtacgttca

SEQ ID NO: 1764 - DNA, 24 bp, Artificial Sequence
  Synthetic oligonucleotide
ttcgatattgccagcagctataaa

SEQ ID NO: 1765 - DNA, 20 bp, Artificial Sequence
  Synthetic oligonucleotide
tccttcagctttcacactgg

SEQ ID NO: 1766 - DNA, 29 bp, Artificial Sequence
  Synthetic oligonucleotide
tccagaagagtcatgcaacttcatttctg

SEQ ID NO: 1767 - DNA, 20 bp, Artificial Sequence
  Synthetic oligonucleotide
aaatcctgttcccacctgac

SEQ ID NO: 1768 - DNA, 20 bp, Artificial Sequence
  Synthetic oligonucleotide
aacatgattatccaagccgc

SEQ ID NO: 1769 - DNA, 24 bp, Artificial Sequence
  Synthetic oligonucleotide
aagccaattttgtccacaatggca

SEQ ID NO: 1770 - DNA, 20 bp, Artificial Sequence
  Synthetic oligonucleotide
gccaacaagcactgttatcg

SEQ ID NO: 1771 - DNA, 22 bp, Artificial Sequence
  Synthetic oligonucleotide
caagtcagttgagacgccagtt

SEQ ID NO: 1772 - DNA, 25 bp, Artificial Sequence
  Synthetic oligonucleotide
ttctatggcggcctgacttcctcca

SEQ ID NO: 1773 - DNA, 20 bp, Artificial Sequence
  Synthetic oligonucleotide
tgcagctctcgtccaaagtg

SEQ ID NO: 1774 - DNA, 20 bp, Artificial Sequence
  Synthetic oligonucleotide
tgtggatgctggattgattt

SEQ ID NO: 1775 - DNA, 25 bp, Artificial Sequence
  Synthetic oligonucleotide
ccactggtgcagctgctaaatagca

SEQ ID NO: 1776 - DNA, 20 bp, Artificial Sequence
  Synthetic oligonucleotide
aagcagcacttcctggtctt

SEQ ID NO: 1777 - DNA, 23 bp, Artificial Sequence
  Synthetic oligonucleotide
agtctgtgagaaacgaccgaaac

SEQ ID NO: 1778 - DNA, 23 bp, Artificial Sequence
  Synthetic oligonucleotide
tcgggcttgggcacctccttctt

SEQ ID NO: 1779 - DNA, 18 bp, Artificial Sequence
  Synthetic oligonucleotide
cggcgtcagcgtgtagct

SEQ ID NO: 1780 - DNA, 20 bp, Artificial Sequence
  Synthetic oligonucleotide
tgcctggacatcctgattct

SEQ ID NO: 1781 - DNA, 26 bp, Artificial Sequence
  Synthetic oligonucleotide
tgcaccaggtataccccagaacaaga

SEQ ID NO: 1782 - DNA, 20 bp, Artificial Sequence
  Synthetic oligonucleotide
aaggccgtctgagaaagtca

SEQ ID NO: 1783 - DNA, 20 bp, Artificial Sequence
  Synthetic oligonucleotide
agtgggagacacctgacctt

SEQ ID NO: 1784 - DNA, 29 bp, Artificial Sequence
  Synthetic oligonucleotide
ttgatcttctgctcaatctcagcttgaga

SEQ ID NO: 1785 - DNA, 20 bp, Artificial Sequence
  Synthetic oligonucleotide
tgatctgggcattgtactcc

SEQ ID NO: 1786 - DNA, 21 bp, Artificial Sequence
  Synthetic oligonucleotide
cgagagggagagcaagaccat

SEQ ID NO: 1787 - DNA, 19 bp, Artificial Sequence
  Synthetic oligonucleotide
ctgcgcggccttcccatca

SEQ ID NO: 1788 - DNA, 24 bp, Artificial Sequence
  Synthetic oligonucleotide
tctcgaatatcgctctctgtgatg

SEQ ID NO: 1789 - DNA, 23 bp, Artificial Sequence
  Synthetic oligonucleotide
ggaaccacattatggatctttgc

SEQ ID NO: 1790 - DNA, 28 bp, Artificial Sequence
  Synthetic oligonucleotide
tagaatgtcaagctaaccaggcgtccgc

SEQ ID NO: 1791 - DNA, 24 bp, Artificial Sequence
  Synthetic oligonucleotide
catgcgacagtacactcttctgaa

SEQ ID NO: 1792 - DNA, 18 bp, Artificial Sequence
  Synthetic oligonucleotide
gggctgggtgagaatgtg

SEQ ID NO: 1793 - DNA, 24 bp, Artificial Sequence
  Synthetic oligonucleotide
ataccagggccggcttcttcctct

SEQ ID NO: 1794 - DNA, 19 bp, Artificial Sequence
  Synthetic oligonucleotide
cacaacatcctccggaatg

SEQ ID NO: 1795 - DNA, 19 bp, Artificial Sequence
  Synthetic oligonucleotide
tgctaactcctgcacagcc

SEQ ID NO: 1796 - DNA, 25 bp, Artificial Sequence
  Synthetic oligonucleotide
tcctcttcctttctgctagcctggc

SEQ ID NO: 1797 - DNA, 20 bp, Artificial Sequence
  Synthetic oligonucleotide
tgctaggtttcccctctgaa

SEQ ID NO: 1798 - DNA, 25 bp, Artificial Sequence
  Synthetic oligonucleotide
tcaagaccatcatcactttcattgt

SEQ ID NO: 1799 - DNA, 21 bp, Artificial Sequence
  Synthetic oligonucleotide
cctcccggtccgcaagcagtt

SEQ ID NO: 1800 - DNA, 27 bp, Artificial Sequence
  Synthetic oligonucleotide
ggatcaggaagtacacggagtataact

SEQ ID NO: 1801 - DNA, 21 bp, Artificial Sequence
  Synthetic oligonucleotide
aagcatgaacaggacttgacc

SEQ ID NO: 1802 - DNA, 24 bp, Artificial Sequence
  Synthetic oligonucleotide
ctttccaacccctggggaagacat

SEQ ID NO: 1803 - DNA, 18 bp, Artificial Sequence
  Synthetic oligonucleotide
cctccccaagtcagttgc

SEQ ID NO: 1804 - DNA, 18 bp, Artificial Sequence
  Synthetic oligonucleotide
cccgttcggtctgaggaa

SEQ ID NO: 1805 - DNA, 19 bp, Artificial Sequence
  Synthetic oligonucleotide
tccggttcgccatgtcccg

SEQ ID NO: 1806 - DNA, 22 bp, Artificial Sequence
  Synthetic oligonucleotide
gagcactcaaggtagccaaagg

SEQ ID NO: 1807 - DNA, 20 bp, Artificial Sequence
  Synthetic oligonucleotide
ccagacgagcgattagaagc

SEQ ID NO: 1808 - DNA, 23 bp, Artificial Sequence
  Synthetic oligonucleotide
tgtgaggtgaatgatttggggga

SEQ ID NO: 1809 - DNA, 20 bp, Artificial Sequence
  Synthetic oligonucleotide
tcctcctcttcctcctcctc

SEQ ID NO: 1810 - DNA, 20 bp, Artificial Sequence
  Synthetic oligonucleotide
accctggaagagatggatca

SEQ ID NO: 1811 - DNA, 26 bp, Artificial Sequence
  Synthetic oligonucleotide
ccatcatacagatcacacactcccgg

SEQ ID NO: 1812 - DNA, 20 bp, Artificial Sequence
  Synthetic oligonucleotide
attgggtccccataaacaaa

SEQ ID NO: 1813 - DNA, 22 bp, Artificial Sequence
  Synthetic oligonucleotide
tgtgcacataggaatgagcttc

SEQ ID NO: 1814 - DNA, 24 bp, Artificial Sequence
  Synthetic oligonucleotide
tcactctctttgctggccaactgc

SEQ ID NO: 1815 - DNA, 20 bp, Artificial Sequence
  Synthetic oligonucleotide
gtttagcacgcaattgctca

SEQ ID NO: 1816 - DNA, 18 bp, Artificial Sequence
  Synthetic oligonucleotide
gatccgagaccctcgctc

SEQ ID NO: 1817 - DNA, 23 bp, Artificial Sequence
  Synthetic oligonucleotide
cccatcaacgtggagagcttgct

SEQ ID NO: 1818 - DNA, 21 bp, Artificial Sequence
  Synthetic oligonucleotide
aggaccaaggaatttaagcca

SEQ ID NO: 1819 - DNA, 24 bp, Artificial Sequence
  Synthetic oligonucleotide
ccattctatcatcaacgggtacaa

SEQ ID NO: 1820 - DNA, 25 bp, Artificial Sequence
  Synthetic oligonucleotide
tctccacagacaaggccaggactcg

SEQ ID NO: 1821 - DNA, 23 bp, Artificial Sequence
  Synthetic oligonucleotide
tcagcaagtgggaaggtgtaatc

SEQ ID NO: 1822 - DNA, 20 bp, Artificial Sequence
  Synthetic oligonucleotide
cagtcggctttaccctatcg

SEQ ID NO: 1823 - DNA, 24 bp, Artificial Sequence
  Synthetic oligonucleotide
caacttcaaccaagtggggacgct

SEQ ID NO: 1824 - DNA, 19 bp, Artificial Sequence
  Synthetic oligonucleotide
tctgctccttcacgtcgtc

SEQ ID NO: 1825 - DNA, 20 bp, Artificial Sequence
  Synthetic oligonucleotide
gggctactggcagctacatt

SEQ ID NO: 1826 - DNA, 25 bp, Artificial Sequence
  Synthetic oligonucleotide
cattggaattgccattagtcccagc

SEQ ID NO: 1827 - DNA, 20 bp, Artificial Sequence
  Synthetic oligonucleotide
ctctcagcatcggtacaagg

SEQ ID NO: 1828 - DNA, 20 bp, Artificial Sequence
  Synthetic oligonucleotide
cagcgggattaaacagtcct

SEQ ID NO: 1829 - DNA, 25 bp, Artificial Sequence
  Synthetic oligonucleotide
ccagcacagccagttaaaagatgca

SEQ ID NO: 1830 - DNA, 20 bp, Artificial Sequence
  Synthetic oligonucleotide
atctgcgttgaagcagtgag

SEQ ID NO: 1831 - DNA, 20 bp, Artificial Sequence
  Synthetic oligonucleotide
gactggagtggtgtttggtg

SEQ ID NO: 1832 - DNA, 26 bp, Artificial Sequence
  Synthetic oligonucleotide
ccagcctattcctgctgctttcattg

SEQ ID NO: 1833 - DNA, 20 bp, Artificial Sequence
  Synthetic oligonucleotide
ctgttacgctcacaatgctg

SEQ ID NO: 1834 - DNA, 20 bp, Artificial Sequence
  Synthetic oligonucleotide
aacagagacattgccaacca

SEQ ID NO: 1835 - DNA, 24 bp, Artificial Sequence
  Synthetic oligonucleotide
ttggatctgcttgctgtccaaacc

SEQ ID NO: 1836 - DNA, 20 bp, Artificial Sequence
  Synthetic oligonucleotide
gtgatttgcccaggaagttt

SEQ ID NO: 1837 - DNA, 20 bp, Artificial Sequence
  Synthetic oligonucleotide
gctctgttgtgtcctgttgc

SEQ ID NO: 1838 - DNA, 23 bp, Artificial Sequence
  Synthetic oligonucleotide
tcagtcacaggaaggccagagcc

SEQ ID NO: 1839 - DNA, 21 bp, Artificial Sequence
  Synthetic oligonucleotide
gtacggagaagccacttcaca

SEQ ID NO: 1840 - DNA, 20 bp, Artificial Sequence
  Synthetic oligonucleotide
tggacaaggtgatgaaggag

SEQ ID NO: 1841 - DNA, 24 bp, Artificial Sequence
  Synthetic oligonucleotide
cctccccgtctccattctcgtcta

SEQ ID NO: 1842 - DNA, 20 bp, Artificial Sequence
  Synthetic oligonucleotide
agcaccacatactcctggaa

SEQ ID NO: 1843 - DNA, 21 bp, Artificial Sequence
  Synthetic oligonucleotide
tggctgtgctggtcactacct

SEQ ID NO: 1844 - DNA, 27 bp, Artificial Sequence
  Synthetic oligonucleotide
cacaagtactcctgccaagagggcgac

SEQ ID NO: 1845 - DNA, 22 bp, Artificial Sequence
  Synthetic oligonucleotide
tcccccttactcagcttgaact

SEQ ID NO: 1846 - DNA, 18 bp, Artificial Sequence
  Synthetic oligonucleotide
gactgctgtcatggcgtg

SEQ ID NO: 1847 - DNA, 24 bp, Artificial Sequence
  Synthetic oligonucleotide
atcacatccagggccttctccaga

SEQ ID NO: 1848 - DNA, 22 bp, Artificial Sequence
  Synthetic oligonucleotide
cgagtacttgtggaaggtggac

SEQ ID NO: 1849 - DNA, 22 bp, Artificial Sequence
  Synthetic oligonucleotide
actccctgataaaggggaattt

SEQ ID NO: 1850 - DNA, 24 bp, Artificial Sequence
  Synthetic oligonucleotide
catgccgtctacagggatgacctg

SEQ ID NO: 1851 - DNA, 21 bp, Artificial Sequence
  Synthetic oligonucleotide
tgaggacactcggtctctagc

SEQ ID NO: 1852 - DNA, 20 bp, Artificial Sequence
  Synthetic oligonucleotide
ctttgggacagagtgcaaga

SEQ ID NO: 1853 - DNA, 24 bp, Artificial Sequence
  Synthetic oligonucleotide
cgatgacttgcaaaatgtcgcagc

SEQ ID NO: 1854 - DNA, 20 bp, Artificial Sequence
  Synthetic oligonucleotide
tggtctctatgttgcgttcc

SEQ ID NO: 1855 - DNA, 21 bp, Artificial Sequence
  Synthetic oligonucleotide
agacaaggatgccgtggataa

SEQ ID NO: 1856 - DNA, 23 bp, Artificial Sequence
  Synthetic oligonucleotide
ttgctcaaggacctggacgccaa

SEQ ID NO: 1857 - DNA, 20 bp, Artificial Sequence
  Synthetic oligonucleotide
gaagtccacctgggcatctc

SEQ ID NO: 1858 - DNA, 20 bp, Artificial Sequence
  Synthetic oligonucleotide
ccttttaccactgcctggtt

SEQ ID NO: 1859 - DNA, 24 bp, Artificial Sequence
  Synthetic oligonucleotide
tccagtgctctttcggcacttctg

SEQ ID NO: 1860 - DNA, 19 bp, Artificial Sequence
  Synthetic oligonucleotide
acaatgctgtgtccttccg

SEQ ID NO: 1861 - DNA, 18 bp, Artificial Sequence
  Synthetic oligonucleotide
ggactcaacgatgggcag

SEQ ID NO: 1862 - DNA, 24 bp, Artificial Sequence
  Synthetic oligonucleotide
ccctgtctgcacctcccagatctt

SEQ ID NO: 1863 - DNA, 20 bp, Artificial Sequence
  Synthetic oligonucleotide
cggaaagattcaaaagcagg

SEQ ID NO: 1864 - DNA, 20 bp, Artificial Sequence
  Synthetic oligonucleotide
gaaattgacgaggggtgtct

SEQ ID NO: 1865 - DNA, 22 bp, Artificial Sequence
  Synthetic oligonucleotide
ctctgagcgcctccatccaagg

SEQ ID NO: 1866 - DNA, 20 bp, Artificial Sequence
  Synthetic oligonucleotide
aggagctaacggagaacctg

SEQ ID NO: 1867 - DNA, 22 bp, Artificial Sequence
  Synthetic oligonucleotide
gctccaggatgtgtttctgttg

SEQ ID NO: 1868 - DNA, 18 bp, Artificial Sequence
  Synthetic oligonucleotide
tcgcgggaccaccggacc

SEQ ID NO: 1869 - DNA, 21 bp, Artificial Sequence
  Synthetic oligonucleotide
acgtggagaagacggcataga

SEQ ID NO: 1870 - DNA, 20 bp, Artificial Sequence
  Synthetic oligonucleotide
cgcgagcccctcattataca

SEQ ID NO: 1871 - DNA, 22 bp, Artificial Sequence
  Synthetic oligonucleotide
ctccccacagcgcatcgaggaa

SEQ ID NO: 1872 - DNA, 19 bp, Artificial Sequence
  Synthetic oligonucleotide
cactcgccgttgacatcct

SEQ ID NO: 1873 - DNA, 20 bp, Artificial Sequence
  Synthetic oligonucleotide
ttccagcccaacacagtgaa

SEQ ID NO: 1874 - DNA, 22 bp, Artificial Sequence
  Synthetic oligonucleotide
actttggcctgcccgctcctct

SEQ ID NO: 1875 - DNA, 18 bp, Artificial Sequence
  Synthetic oligonucleotide
gagtcgggtcgccaggtt

SEQ ID NO: 1876 - DNA, 19 bp, Artificial Sequence
  Synthetic oligonucleotide
caagctgaacggtgtgtcc

SEQ ID NO: 1877 - DNA, 24 bp, Artificial Sequence
  Synthetic oligonucleotide
cagcaccgatttcttcaggtccct

SEQ ID NO: 1878 - DNA, 19 bp, Artificial Sequence
  Synthetic oligonucleotide
tgcaagctgtctttgagcc

SEQ ID NO: 1879 - DNA, 18 bp, Artificial Sequence
  Synthetic oligonucleotide
tacaggatgaggctgggc

SEQ ID NO: 1880 - DNA, 24 bp, Artificial Sequence
  Synthetic oligonucleotide
cctgggacagcctatgtaaggcca

SEQ ID NO: 1881 - DNA, 18 bp, Artificial Sequence
  Synthetic oligonucleotide
gttgttagggcaaggggc

SEQ ID NO: 1882 - DNA, 23 bp, Artificial Sequence
  Synthetic oligonucleotide
cagtggagaccagttgggtagtg

SEQ ID NO: 1883 - DNA, 28 bp, Artificial Sequence
  Synthetic oligonucleotide
cacacatgcagagcttgtagcgtaccca

SEQ ID NO: 1884 - DNA, 20 bp, Artificial Sequence
  Synthetic oligonucleotide
ccttgaagagcgtcccatca

SEQ ID NO: 1885 - DNA, 20 bp, Artificial Sequence
  Synthetic oligonucleotide
ccaacaccttcttggcttct

SEQ ID NO: 1886 - DNA, 24 bp, Artificial Sequence
  Synthetic oligonucleotide
cctgtgttcttgctgagcaccctc

SEQ ID NO: 1887 - DNA, 20 bp, Artificial Sequence
  Synthetic oligonucleotide
ctgttatcccaacccaaacc

SEQ ID NO: 1888 - DNA, 21 bp, Artificial Sequence
  Synthetic oligonucleotide
gtccaaggcacatatccactg

SEQ ID NO: 1889 - DNA, 24 bp, Artificial Sequence
  Synthetic oligonucleotide
caccgagttctctgctttcaccga

SEQ ID NO: 1890 - DNA, 18 bp, Artificial Sequence
  Synthetic oligonucleotide
gaagcagcctcccgattt

SEQ ID NO: 1891 - DNA, 20 bp, Artificial Sequence
  Synthetic oligonucleotide
aacggactccctcaatttgt

SEQ ID NO: 1892 - DNA, 24 bp, Artificial Sequence
  Synthetic oligonucleotide
tgtccatggtcatgcaaatcttgc

SEQ ID NO: 1893 - DNA, 20 bp, Artificial Sequence
  Synthetic oligonucleotide
gaaattgcagggtccaagat

SEQ ID NO: 1894 - DNA, 21 bp, Artificial Sequence
  Synthetic oligonucleotide
ttggcattggaactacattca

SEQ ID NO: 1895 - DNA, 24 bp, Artificial Sequence
  Synthetic oligonucleotide
tccgcggtatcctcggattagttc

SEQ ID NO: 1896 - DNA, 19 bp, Artificial Sequence
  Synthetic oligonucleotide
ggtatggagaagggggtcc

SEQ ID NO: 1897 - DNA, 20 bp, Artificial Sequence
  Synthetic oligonucleotide
aaccacagttggaggaggac

SEQ ID NO: 1898 - DNA, 23 bp, Artificial Sequence
  Synthetic oligonucleotide
cagagacagtttccctccccgct

SEQ ID NO: 1899 - DNA, 20 bp, Artificial Sequence
  Synthetic oligonucleotide
cgaaggaagggtgttggtat

SEQ ID NO: 1900 - DNA, 18 bp, Artificial Sequence
  Synthetic oligonucleotide
tccagcccaaatcctcct

SEQ ID NO: 1901 - DNA, 24 bp, Artificial Sequence
  Synthetic oligonucleotide
tggcacatcctaccccagatgcta

SEQ ID NO: 1902 - DNA, 20 bp, Artificial Sequence
  Synthetic oligonucleotide
ggtgtcctggagtccttgaa

SEQ ID NO: 1903 - DNA, 20 bp, Artificial Sequence
  Synthetic oligonucleotide
gatggtaggaagggatgtgc

SEQ ID NO: 1904 - DNA, 23 bp, Artificial Sequence
  Synthetic oligonucleotide
cgcctctccacgcactcagctat

SEQ ID NO: 1905 - DNA, 21 bp, Artificial Sequence
  Synthetic oligonucleotide
cacaaggagctgtgaatgagg

SEQ ID NO: 1906 - DNA, 20 bp, Artificial Sequence
  Synthetic oligonucleotide
ccagagtcatgctcatccag

SEQ ID NO: 1907 - DNA, 23 bp, Artificial Sequence
  Synthetic oligonucleotide
ctgtccctgcactggtgcaactg

SEQ ID NO: 1908 - DNA, 20 bp, Artificial Sequence
  Synthetic oligonucleotide
ccaccttcagcctctgaaat

SEQ ID NO: 1909 - DNA, 20 bp, Artificial Sequence
  Synthetic oligonucleotide
agctggggtgtctgtttcat

SEQ ID NO: 1910 - DNA, 23 bp, Artificial Sequence
  Synthetic oligonucleotide
cctgacttcaggtcaagggatgg

SEQ ID NO: 1911 - DNA, 20 bp, Artificial Sequence
  Synthetic oligonucleotide
acagcaaggcgagcataaat

SEQ ID NO: 1912 - DNA, 22 bp, Artificial Sequence
  Synthetic oligonucleotide
ccattgcctttgctttgttcat

SEQ ID NO: 1913 - DNA, 27 bp, Artificial Sequence
  Synthetic oligonucleotide
tcccatggtttttattctgccctgctg

SEQ ID NO: 1914 - DNA, 21 bp, Artificial Sequence
  Synthetic oligonucleotide
ttccggatttcctttctttgc

SEQ ID NO: 1915 - DNA, 23 bp, Artificial Sequence
  Synthetic oligonucleotide
agttgcagaatctaagcctggaa

SEQ ID NO: 1916 - DNA, 20 bp, Artificial Sequence
  Synthetic oligonucleotide
cctgcggctttcggatccca

SEQ ID NO: 1917 - DNA, 25 bp, Artificial Sequence
  Synthetic oligonucleotide
tgagttttttgcgagagtattgaca

SEQ ID NO: 1918 - DNA, 20 bp, Artificial Sequence
  Synthetic oligonucleotide
tctgccagtgctgaattctt

SEQ ID NO: 1919 - DNA, 24 bp, Artificial Sequence
  Synthetic oligonucleotide
tgctgacattgccctggctcctat

SEQ ID NO: 1920 - DNA, 20 bp, Artificial Sequence
  Synthetic oligonucleotide
ttcgaaccttagcagcttcc

SEQ ID NO: 1921 - DNA, 18 bp, Artificial Sequence
  Synthetic oligonucleotide
gcctgagtctcctgtgcc

SEQ ID NO: 1922 - DNA, 24 bp, Artificial Sequence
  Synthetic oligonucleotide
acatcccaggcttcaccctgaatg

SEQ ID NO: 1923 - DNA, 19 bp, Artificial Sequence
  Synthetic oligonucleotide
agtctccaccctcaggcat

SEQ ID NO: 1924 - DNA, 19 bp, Artificial Sequence
  Synthetic oligonucleotide
ccgttcgaagagtcgtgag

SEQ ID NO: 1925 - DNA, 24 bp, Artificial Sequence
  Synthetic oligonucleotide
tctccgaatcttaacccgtcaccc

SEQ ID NO: 1926 - DNA, 20 bp, Artificial Sequence
  Synthetic oligonucleotide
agtccagccactagcacctc

SEQ ID NO: 1927 - DNA, 20 bp, Artificial Sequence
  Synthetic oligonucleotide
cctgctttcaaccacattga

SEQ ID NO: 1928 - DNA, 24 bp, Artificial Sequence
  Synthetic oligonucleotide
tcccattgctcttgccactctgat

SEQ ID NO: 1929 - DNA, 20 bp, Artificial Sequence
  Synthetic oligonucleotide
agagcagcttcacaaacgag

SEQ ID NO: 1930 - DNA, 18 bp, Artificial Sequence
  Synthetic oligonucleotide
gcgcagaggccagttaaa

SEQ ID NO: 1931 - DNA, 24 bp, Artificial Sequence
  Synthetic oligonucleotide
agatcacctcctcgaacccactcc

SEQ ID NO: 1932 - DNA, 18 bp, Artificial Sequence
  Synthetic oligonucleotide
agctgagctgtgggttgc

SEQ ID NO: 1933 - DNA, 19 bp, Artificial Sequence
  Synthetic oligonucleotide
atggccaatgtttgatgct

SEQ ID NO: 1934 - DNA, 25 bp, Artificial Sequence
  Synthetic oligonucleotide
tggccatccatctcacagaaattgg

SEQ ID NO: 1935 - DNA, 20 bp, Artificial Sequence
  Synthetic oligonucleotide
acacttcaagtcacgcttgc

SEQ ID NO: 1936 - DNA, 19 bp, Artificial Sequence
  Synthetic oligonucleotide
agggactgtcctggcacat

SEQ ID NO: 1937 - DNA, 24 bp, Artificial Sequence
  Synthetic oligonucleotide
agcaaaagacccaggacatctgca

SEQ ID NO: 1938 - DNA, 19 bp, Artificial Sequence
  Synthetic oligonucleotide
caacaaatttgccgcagtc

SEQ ID NO: 1939 - DNA, 20 bp, Artificial Sequence
  Synthetic oligonucleotide
cccaatcggaagcctaacta

SEQ ID NO: 1940 - DNA, 25 bp, Artificial Sequence
  Synthetic oligonucleotide
tctggattagagtcctgcagctcgc

SEQ ID NO: 1941 - DNA, 20 bp, Artificial Sequence
  Synthetic oligonucleotide
gtagggctgctggaaggtaa

SEQ ID NO: 1942 - DNA, 19 bp, Artificial Sequence
  Synthetic oligonucleotide
ggctggccaaacataagca

SEQ ID NO: 1943 - DNA, 29 bp, Artificial Sequence
  Synthetic oligonucleotide
ctgcactgcgatgcccagtctagaaaatc

SEQ ID NO: 1944 - DNA, 26 bp, Artificial Sequence
  Synthetic oligonucleotide
tccttgtcacagtatttacagctgaa

SEQ ID NO: 1945 - DNA, 20 bp, Artificial Sequence
  Synthetic oligonucleotide
ggctggtcggcagagagtag

SEQ ID NO: 1946 - DNA, 29 bp, Artificial Sequence
  Synthetic oligonucleotide
aaactcatgtaaaccacggccgaatgttg

SEQ ID NO: 1947 - DNA, 21 bp, Artificial Sequence
  Synthetic oligonucleotide
tgaggaaaggtttgggattga

SEQ ID NO: 1948 - DNA, 20 bp, Artificial Sequence
  Synthetic oligonucleotide
tgaagagaggcatgttggag

SEQ ID NO: 1949 - DNA, 24 bp, Artificial Sequence
  Synthetic oligonucleotide
tttgtcagcagtcacattgcccaa

SEQ ID NO: 1950 - DNA, 20 bp, Artificial Sequence
  Synthetic oligonucleotide
aatagacacatcggccacac

SEQ ID NO: 1951 - DNA, 21 bp, Artificial Sequence
  Synthetic oligonucleotide
gcttgtccaaatcaggatcca

SEQ ID NO: 1952 - DNA, 27 bp, Artificial Sequence
  Synthetic oligonucleotide
aacaacaggccttattccactgctggg

SEQ ID NO: 1953 - DNA, 19 bp, Artificial Sequence
  Synthetic oligonucleotide
agcgtgctcccacacatca

SEQ ID NO: 1954 - DNA, 20 bp, Artificial Sequence
  Synthetic oligonucleotide
tctgcaccaaattctccaag

SEQ ID NO: 1955 - DNA, 23 bp, Artificial Sequence
  Synthetic oligonucleotide
aacaccgttaacacctccgcctg

SEQ ID NO: 1956 - DNA, 20 bp, Artificial Sequence
  Synthetic oligonucleotide
gtggtactggaagcaccaga

SEQ ID NO: 1957 - DNA, 18 bp, Artificial Sequence
  Synthetic oligonucleotide
tcgtgtgcaagcctgaga

SEQ ID NO: 1958 - DNA, 23 bp, Artificial Sequence
  Synthetic oligonucleotide
ctcccctaccaggggcatgactc

SEQ ID NO: 1959 - DNA, 19 bp, Artificial Sequence
  Synthetic oligonucleotide
ctgtcggggagattcacac

SEQ ID NO: 1960 - DNA, 23 bp, Artificial Sequence
  Synthetic oligonucleotide
tcttccctgtacactggcagttc

SEQ ID NO: 1961 - DNA, 22 bp, Artificial Sequence
  Synthetic oligonucleotide
tggaccagcaccccattgacgg

SEQ ID NO: 1962 - DNA, 20 bp, Artificial Sequence
  Synthetic oligonucleotide
agctcggtgtgggagaggta

SEQ ID NO: 1963 - DNA, 19 bp, Artificial Sequence
  Synthetic oligonucleotide
aggaatgcagcggattcct

SEQ ID NO: 1964 - DNA, 23 bp, Artificial Sequence
  Synthetic oligonucleotide
cccaagtgctcccagaaggcagg

SEQ ID NO: 1965 - DNA, 20 bp, Artificial Sequence
  Synthetic oligonucleotide
tcgctggagtggtcttcaga

SEQ ID NO: 1966 - DNA, 22 bp, Artificial Sequence
  Synthetic oligonucleotide
cagaccagtccctggtcatagg

SEQ ID NO: 1967 - DNA, 23 bp, Artificial Sequence
  Synthetic oligonucleotide
ctgggtccggattgccctttcag

SEQ ID NO: 1968 - DNA, 24 bp, Artificial Sequence
  Synthetic oligonucleotide
ccttcaagtcatccacaatcagtt

SEQ ID NO: 1969 - DNA, 20 bp, Artificial Sequence
  Synthetic oligonucleotide
tgtggcaagtgcaaatgtaa

SEQ ID NO: 1970 - DNA, 24 bp, Artificial Sequence
  Synthetic oligonucleotide
cagaggccttgggtaggtgcactc

SEQ ID NO: 1971 - DNA, 20 bp, Artificial Sequence
  Synthetic oligonucleotide
gtcgcagatccagtctgatg

SEQ ID NO: 1972 - DNA, 20 bp, Artificial Sequence
  Synthetic oligonucleotide
agatggaagaagccaacctg

SEQ ID NO: 1973 - DNA, 22 bp, Artificial Sequence
  Synthetic oligonucleotide
ctggatcagctcctgggccttc

SEQ ID NO: 1974 - DNA, 19 bp, Artificial Sequence
  Synthetic oligonucleotide
ctgtggctgaggatctggt

SEQ ID NO: 1975 - DNA, 20 bp, Artificial Sequence
  Synthetic oligonucleotide
tgactgcacatggaacattg

SEQ ID NO: 1976 - DNA, 22 bp, Artificial Sequence
  Synthetic oligonucleotide
aggtgcccaacaaccagcatgt

SEQ ID NO: 1977 - DNA, 20 bp, Artificial Sequence
  Synthetic oligonucleotide
aagaatttgaagcgcacctt

SEQ ID NO: 1978 - DNA, 20 bp, Artificial Sequence
  Synthetic oligonucleotide
gggctcagctttcagaagtg

SEQ ID NO: 1979 - DNA, 25 bp, Artificial Sequence
  Synthetic oligonucleotide
tggcagttttcttctgtcaccaaaa

SEQ ID NO: 1980 - DNA, 20 bp, Artificial Sequence
  Synthetic oligonucleotide
acatgttcagctggtccaca

SEQ ID NO: 1981 - DNA, 20 bp, Artificial Sequence
  Synthetic oligonucleotide
tcacatgccactttggtgtt

SEQ ID NO: 1982 - DNA, 22 bp, Artificial Sequence
  Synthetic oligonucleotide
tcctgggagagattgaccagca

SEQ ID NO: 1983 - DNA, 20 bp, Artificial Sequence
  Synthetic oligonucleotide
cttgcaggaagcggctatac

SEQ ID NO: 1984 - DNA, 21 bp, Artificial Sequence
  Synthetic oligonucleotide
gaggcgctcaacatgaaattc

SEQ ID NO: 1985 - DNA, 22 bp, Artificial Sequence
  Synthetic oligonucleotide
cggttgctctgcacttcggcct

SEQ ID NO: 1986 - DNA, 20 bp, Artificial Sequence
  Synthetic oligonucleotide
gccaggaacacgaggttctc

SEQ ID NO: 1987 - DNA, 20 bp, Artificial Sequence
  Synthetic oligonucleotide
ccagtggtggtgatcgttca

SEQ ID NO: 1988 - DNA, 23 bp, Artificial Sequence
  Synthetic oligonucleotide
cagccaggacaacaatgcgacgg

SEQ ID NO: 1989 - DNA, 21 bp, Artificial Sequence
  Synthetic oligonucleotide
gcaaaagcattgtcccagaga

SEQ ID NO: 1990 - DNA, 19 bp, Artificial Sequence
  Synthetic oligonucleotide
ctccgaggtgaggaggact

SEQ ID NO: 1991 - DNA, 24 bp, Artificial Sequence
  Synthetic oligonucleotide
cacatcaaacgcacatcccatgag

SEQ ID NO: 1992 - DNA, 20 bp, Artificial Sequence
  Synthetic oligonucleotide
acctctccctggttatgcac

SEQ ID NO: 1993 - DNA, 18 bp, Artificial Sequence
  Synthetic oligonucleotide
ggactcggagacgctgtg

SEQ ID NO: 1994 - DNA, 24 bp, Artificial Sequence
  Synthetic oligonucleotide
ttcttgaggatcttgacggccctc

SEQ ID NO: 1995 - DNA, 20 bp, Artificial Sequence
  Synthetic oligonucleotide
gggatccttcgcaacttctt

SEQ ID NO: 1996 - DNA, 20 bp, Artificial Sequence
  Synthetic oligonucleotide
catcttccaggaggaccact

SEQ ID NO: 1997 - DNA, 24 bp, Artificial Sequence
  Synthetic oligonucleotide
ctctgtggcaccctggactacctg

SEQ ID NO: 1998 - DNA, 20 bp, Artificial Sequence
  Synthetic oligonucleotide
tccgaccttcaatcatttca

SEQ ID NO: 1999 - DNA, 20 bp, Artificial Sequence
  Synthetic oligonucleotide
aatacccaacgcacaaatga

SEQ ID NO: 2000 - DNA, 23 bp, Artificial Sequence
  Synthetic oligonucleotide
cacgttctctgccccgtttcttg

SEQ ID NO: 2001 - DNA, 20 bp, Artificial Sequence
  Synthetic oligonucleotide
ggagacaatgcaaaccacac

SEQ ID NO: 2002 - DNA, 20 bp, Artificial Sequence
  Synthetic oligonucleotide
cctggaggctgcaacatacc

SEQ ID NO: 2003 - DNA, 25 bp, Artificial Sequence
  Synthetic oligonucleotide
atcctcctgaagcccttttcgcagc

SEQ ID NO: 2004 - DNA, 23 bp, Artificial Sequence
  Synthetic oligonucleotide
tacaatggctttggaggatagca

SEQ ID NO: 2005 - DNA, 25 bp, Artificial Sequence
  Synthetic oligonucleotide
gaagatccctttcctcctactgttc

SEQ ID NO: 2006 - DNA, 22 bp, Artificial Sequence
  Synthetic oligonucleotide
cttcgtggctctcggcttccca

SEQ ID NO: 2007 - DNA, 20 bp, Artificial Sequence
  Synthetic oligonucleotide
ggatgatgttcggccttgat

SEQ ID NO: 2008 - DNA, 20 bp, Artificial Sequence
  Synthetic oligonucleotide
tgttttgattcccgggctta

SEQ ID NO: 2009 - DNA, 28 bp, Artificial Sequence
  Synthetic oligonucleotide
tgccttcttcctccctcacttctcacct

SEQ ID NO: 2010 - DNA, 24 bp, Artificial Sequence
  Synthetic oligonucleotide
caaagctgtcagctctagcaaaag

SEQ ID NO: 2011 - DNA, 20 bp, Artificial Sequence
  Synthetic oligonucleotide
gatggagcaggtggctcagt

SEQ ID NO: 2012 - DNA, 24 bp, Artificial Sequence
  Synthetic oligonucleotide
cccagagtcctcagccgccttcag

SEQ ID NO: 2013 - DNA, 25 bp, Artificial Sequence
  Synthetic oligonucleotide
agtctggaacatgtcagtcttgatg

SEQ ID NO: 2014 - DNA, 19 bp, Artificial Sequence
  Synthetic oligonucleotide
gcccgaaacgccgaatata

SEQ ID NO: 2015 - DNA, 21 bp, Artificial Sequence
  Synthetic oligonucleotide
taccgcagcaaaccgcttggg

SEQ ID NO: 2016 - DNA, 23 bp, Artificial Sequence
  Synthetic oligonucleotide
cgtggctctcttatcctcatgat

SEQ ID NO: 2017 - DNA, 18 bp, Artificial Sequence
  Synthetic oligonucleotide
gaggtcctgagcactgcc

SEQ ID NO: 2018 - DNA, 24 bp, Artificial Sequence
  Synthetic oligonucleotide
ctgggttcacaggctcctttgtcc

SEQ ID NO: 2019 - DNA, 19 bp, Artificial Sequence
  Synthetic oligonucleotide
gatgtgggaccatgcttgt

SEQ ID NO: 2020 - DNA, 20 bp, Artificial Sequence
  Synthetic oligonucleotide
gcagctgcagtcaacagttc

SEQ ID NO: 2021 - DNA, 24 bp, Artificial Sequence
  Synthetic oligonucleotide
aagtcatggcccaaatccagtgtg

SEQ ID NO: 2022 - DNA, 18 bp, Artificial Sequence
  Synthetic oligonucleotide
ctgtgaatggggaggggt

SEQ ID NO: 2023 - DNA, 19 bp, Artificial Sequence
  Synthetic oligonucleotide
ccgggacactttccagaag

SEQ ID NO: 2024 - DNA, 24 bp, Artificial Sequence
  Synthetic oligonucleotide
tctcacttcggcgaaatagtcccg

SEQ ID NO: 2025 - DNA, 18 bp, Artificial Sequence
  Synthetic oligonucleotide
agaacgcgctgtcctgag

SEQ ID NO: 2026 - DNA, 20 bp, Artificial Sequence
  Synthetic oligonucleotide
ccaatcacgacaggaggatt

SEQ ID NO: 2027 - DNA, 24 bp, Artificial Sequence
  Synthetic oligonucleotide
agacacccctaccccacagctctg

SEQ ID NO: 2028 - DNA, 19 bp, Artificial Sequence
  Synthetic oligonucleotide
tggacacggaagcattgac

SEQ ID NO: 2029 - DNA, 24 bp, Artificial Sequence
  Synthetic oligonucleotide
ctgactgctctgcttaaaggtgaa

SEQ ID NO: 2030 - DNA, 29 bp, Artificial Sequence
  Synthetic oligonucleotide
tagcaggaacaacaacaaaagccaaccaa

SEQ ID NO: 2031 - DNA, 23 bp, Artificial Sequence
  Synthetic oligonucleotide
atgtcttgcactggctaccttgt

SEQ ID NO: 2032 - DNA, 28 bp, Artificial Sequence
  Synthetic oligonucleotide
acttcggtgctacttaacaacttacatc

SEQ ID NO: 2033 - DNA, 25 bp, Artificial Sequence
  Synthetic oligonucleotide
agctcggaccacgtactgctccctg

SEQ ID NO: 2034 - DNA, 19 bp, Artificial Sequence
  Synthetic oligonucleotide
cctgggccttggtgttgac

SEQ ID NO: 2035 - DNA, 19 bp, Artificial Sequence
  Synthetic oligonucleotide
aagaggaacggagcgagtc

SEQ ID NO: 2036 - DNA, 23 bp, Artificial Sequence
  Synthetic oligonucleotide
cacgtcccacagctcagggaatc

SEQ ID NO: 2037 - DNA, 19 bp, Artificial Sequence
  Synthetic oligonucleotide
atgtgtgagccgagtcctg

SEQ ID NO: 2038 - DNA, 23 bp, Artificial Sequence
  Synthetic oligonucleotide
gacatggagaacaagctgtttgc

SEQ ID NO: 2039 - DNA, 21 bp, Artificial Sequence
  Synthetic oligonucleotide
accaaacgcaggagcagcccg

SEQ ID NO: 2040 - DNA, 24 bp, Artificial Sequence
  Synthetic oligonucleotide
gaggtgtcaccaacaagaaatcat

SEQ ID NO: 2041 - DNA, 25 bp, Artificial Sequence
  Synthetic oligonucleotide
aggcactgttcatctcagtttttct

SEQ ID NO: 2042 - DNA, 24 bp, Artificial Sequence
  Synthetic oligonucleotide
cagaaagcttgccgggagcaaagg

SEQ ID NO: 2043 - DNA, 25 bp, Artificial Sequence
  Synthetic oligonucleotide
catcaggctccagatatgaactttc

SEQ ID NO: 2044 - DNA, 20 bp, Artificial Sequence
  Synthetic oligonucleotide
ggtgtgccacagaccttcct

SEQ ID NO: 2045 - DNA, 27 bp, Artificial Sequence
  Synthetic oligonucleotide
ttggcctgtaatcacctgtgcagcctt

SEQ ID NO: 2046 - DNA, 24 bp, Artificial Sequence
  Synthetic oligonucleotide
acggagttcttgacagagttttga

SEQ ID NO: 2047 - DNA, 20 bp, Artificial Sequence
  Synthetic oligonucleotide
accagtcccccagaagacta

SEQ ID NO: 2048 - DNA, 21 bp, Artificial Sequence
  Synthetic oligonucleotide
tcctgagcccgaggaagtccc

SEQ ID NO: 2049 - DNA, 20 bp, Artificial Sequence
  Synthetic oligonucleotide
cctggtgctgttgtagatgg

SEQ ID NO: 2050 - DNA, 22 bp, Artificial Sequence
  Synthetic oligonucleotide
ggatcgagctcttccagatcct

SEQ ID NO: 2051 - DNA, 21 bp, Artificial Sequence
  Synthetic oligonucleotide
cggccagatgagcacattgcc

SEQ ID NO: 2052 - DNA, 20 bp, Artificial Sequence
  Synthetic oligonucleotide
gccaccgatatagcgctgtt

SEQ ID NO: 2053 - DNA, 19 bp, Artificial Sequence
  Synthetic oligonucleotide
gctacgagtgctgtcctgg

SEQ ID NO: 2054 - DNA, 24 bp, Artificial Sequence
  Synthetic oligonucleotide
ccttctccccagggaccttttcat

SEQ ID NO: 2055 - DNA, 19 bp, Artificial Sequence
  Synthetic oligonucleotide
agtggtagggctgctggac

SEQ ID NO: 2056 - DNA, 18 bp, Artificial Sequence
  Synthetic oligonucleotide
gtcatcacctggccttgg

SEQ ID NO: 2057 - DNA, 24 bp, Artificial Sequence
  Synthetic oligonucleotide
agcaatgacagctgccagttccac

SEQ ID NO: 2058 - DNA, 19 bp, Artificial Sequence
  Synthetic oligonucleotide
gcagacgaagcacactggt

SEQ ID NO: 2059 - DNA, 20 bp, Artificial Sequence
  Synthetic oligonucleotide
aacaccaatgggttccatct

SEQ ID NO: 2060 - DNA, 24 bp, Artificial Sequence
  Synthetic oligonucleotide
ttctgggctcctgattgctcaagc

SEQ ID NO: 2061 - DNA, 20 bp, Artificial Sequence
  Synthetic oligonucleotide
cctcttcatcaggccaaact

SEQ ID NO: 2062 - DNA, 22 bp, Artificial Sequence
  Synthetic oligonucleotide
catccgcaaagtgactgaagag

SEQ ID NO: 2063 - DNA, 22 bp, Artificial Sequence
  Synthetic oligonucleotide
ccaatgagctgaggcggcctcc

SEQ ID NO: 2064 - DNA, 27 bp, Artificial Sequence
  Synthetic oligonucleotide
gtactgaactccgttgtgatagcatag

SEQ ID NO: 2065 - DNA, 20 bp, Artificial Sequence
  Synthetic oligonucleotide
ggacaagaccctctcaggct

SEQ ID NO: 2066 - DNA, 24 bp, Artificial Sequence
  Synthetic oligonucleotide
caagctcccaagagcttccagagc

SEQ ID NO: 2067 - DNA, 18 bp, Artificial Sequence
  Synthetic oligonucleotide
ttggaggctgtgggtcag

SEQ ID NO: 2068 - DNA, 19 bp, Artificial Sequence
  Synthetic oligonucleotide
tccctgcggtcccagatag

SEQ ID NO: 2069 - DNA, 25 bp, Artificial Sequence
  Synthetic oligonucleotide
atcctgcccggagtggaactgaagc

SEQ ID NO: 2070 - DNA, 20 bp, Artificial Sequence
  Synthetic oligonucleotide
gtgggaacagggtggacact

SEQ ID NO: 2071 - DNA, 22 bp, Artificial Sequence
  Synthetic oligonucleotide
tcaccctctgtgacttcatcgt

SEQ ID NO: 2072 - DNA, 22 bp, Artificial Sequence
  Synthetic oligonucleotide
ccctgggacaccctgagcacca

SEQ ID NO: 2073 - DNA, 22 bp, Artificial Sequence
  Synthetic oligonucleotide
tgtggttcaggctcttcttctg

SEQ ID NO: 2074 - DNA, 20 bp, Artificial Sequence
  Synthetic oligonucleotide
ctacctgccttgctttgtga

SEQ ID NO: 2075 - DNA, 24 bp, Artificial Sequence
  Synthetic oligonucleotide
ccaagaacgagtgtctctggaccg

SEQ ID NO: 2076 - DNA, 20 bp, Artificial Sequence
  Synthetic oligonucleotide
accgaaattggagagcatgt

SEQ ID NO: 2077 - DNA, 20 bp, Artificial Sequence
  Synthetic oligonucleotide
actttgctgggacaaaggtc

SEQ ID NO: 2078 - DNA, 21 bp, Artificial Sequence
  Synthetic oligonucleotide
ctcgggcctgcccacttcttc

SEQ ID NO: 2079 - DNA, 20 bp, Artificial Sequence
  Synthetic oligonucleotide
cacatggactcctcagcatc

SEQ ID NO: 2080 - DNA, 20 bp, Artificial Sequence
  Synthetic oligonucleotide
gccgggaagaccgtaattgt

SEQ ID NO: 2081 - DNA, 26 bp, Artificial Sequence
  Synthetic oligonucleotide
caaatggcttcctctggaaggtccca

SEQ ID NO: 2082 - DNA, 18 bp, Artificial Sequence
  Synthetic oligonucleotide
cagcggcaccaggttcag

SEQ ID NO: 2083 - DNA, 22 bp, Artificial Sequence
  Synthetic oligonucleotide
aagcagaagggagagcgtaaga

SEQ ID NO: 2084 - DNA, 26 bp, Artificial Sequence
  Synthetic oligonucleotide
cttccaggcacacaagaattgtgggc

SEQ ID NO: 2085 - DNA, 21 bp, Artificial Sequence
  Synthetic oligonucleotide
ccttggcctcaatctcactca

SEQ ID NO: 2086 - DNA, 18 bp, Artificial Sequence
  Synthetic oligonucleotide
cagaaggatgcctgtggc

SEQ ID NO: 2087 - DNA, 24 bp, Artificial Sequence
  Synthetic oligonucleotide
attccgttgcctgacactgtgctc

SEQ ID NO: 2088 - DNA, 18 bp, Artificial Sequence
  Synthetic oligonucleotide
gtagacctgcggctctgg

SEQ ID NO: 2089 - DNA, 20 bp, Artificial Sequence
  Synthetic oligonucleotide
gaaatcgccagcttcgataa

SEQ ID NO: 2090 - DNA, 24 bp, Artificial Sequence
  Synthetic oligonucleotide
cgtctccgttttcttcagcttggc

SEQ ID NO: 2091 - DNA, 19 bp, Artificial Sequence
  Synthetic oligonucleotide
gtcggcagggtgttctttt

SEQ ID NO: 2092 - DNA, 26 bp, Artificial Sequence
  Synthetic oligonucleotide
cacatcaaagaactactgacaacgaa

SEQ ID NO: 2093 - DNA, 18 bp, Artificial Sequence
  Synthetic oligonucleotide
ccgcgcctgcctttccca

SEQ ID NO: 2094 - DNA, 23 bp, Artificial Sequence
  Synthetic oligonucleotide
cctgccagccagatagatagaca

SEQ ID NO: 2095 - DNA, 18 bp, Artificial Sequence
  Synthetic oligonucleotide
agctcggaacctcaccgt

SEQ ID NO: 2096 - DNA, 23 bp, Artificial Sequence
  Synthetic oligonucleotide
cagccttcgggctgtggacatac

SEQ ID NO: 2097 - DNA, 18 bp, Artificial Sequence
  Synthetic oligonucleotide
gtagcagccttgaggccc

SEQ ID NO: 2098 - DNA, 20 bp, Artificial Sequence
  Synthetic oligonucleotide
ggagaagggtgaccgactca

SEQ ID NO: 2099 - DNA, 24 bp, Artificial Sequence
  Synthetic oligonucleotide
cgctgagatcaatcggcccgacta

SEQ ID NO: 2100 - DNA, 18 bp, Artificial Sequence
  Synthetic oligonucleotide
tgcccagactcggcaaag

SEQ ID NO: 2101 - DNA, 21 bp, Artificial Sequence
  Synthetic oligonucleotide
tctcacctcgctatggttcgt

SEQ ID NO: 2102 - DNA, 23 bp, Artificial Sequence
  Synthetic oligonucleotide
tgcctctgcagtgcgtcctctgg

SEQ ID NO: 2103 - DNA, 19 bp, Artificial Sequence
  Synthetic oligonucleotide
gatggacagcggtcagcaa

SEQ ID NO: 2104 - DNA, 19 bp, Artificial Sequence
  Synthetic oligonucleotide
cctcagcaccagggtacca

SEQ ID NO: 2105 - DNA, 24 bp, Artificial Sequence
  Synthetic oligonucleotide
tgacggcacgctcacactcctcag

SEQ ID NO: 2106 - DNA, 21 bp, Artificial Sequence
  Synthetic oligonucleotide
tgtcctggaaagccacaaagt

SEQ ID NO: 2107 - DNA, 22 bp, Artificial Sequence
  Synthetic oligonucleotide
cttcatcttccctctacccaga

SEQ ID NO: 2108 - DNA, 24 bp, Artificial Sequence
  Synthetic oligonucleotide
caggggttggaccctttccatctt

SEQ ID NO: 2109 - DNA, 20 bp, Artificial Sequence
  Synthetic oligonucleotide
gctgcatttcccacattctc

SEQ ID NO: 2110 - DNA, 20 bp, Artificial Sequence
  Synthetic oligonucleotide
aatccaagggggagagtgat

SEQ ID NO: 2111 - DNA, 26 bp, Artificial Sequence
  Synthetic oligonucleotide
catatggactttgactcagctgtggc

SEQ ID NO: 2112 - DNA, 20 bp, Artificial Sequence
  Synthetic oligonucleotide
gtacagattttgcccgagga

SEQ ID NO: 2113 - DNA, 21 bp, Artificial Sequence
  Synthetic oligonucleotide
tgtggacatcttcccctcaga

SEQ ID NO: 2114 - DNA, 24 bp, Artificial Sequence
  Synthetic oligonucleotide
ttccctactgagccaccttctctg

SEQ ID NO: 2115 - DNA, 18 bp, Artificial Sequence
  Synthetic oligonucleotide
ctagcccgaccggttcgt

SEQ ID NO: 2116 - DNA, 24 bp, Artificial Sequence
  Synthetic oligonucleotide
ctatatgcagccagagatgtgaca

SEQ ID NO: 2117 - DNA, 23 bp, Artificial Sequence
  Synthetic oligonucleotide
acagcctgccactcatcacagcc

SEQ ID NO: 2118 - DNA, 24 bp, Artificial Sequence
  Synthetic oligonucleotide
ccacgagtttcttactgagaatgg

SEQ ID NO: 2119 - DNA, 20 bp, Artificial Sequence
  Synthetic oligonucleotide
tgctgttgctgagtctgttg

SEQ ID NO: 2120 - DNA, 24 bp, Artificial Sequence
  Synthetic oligonucleotide
ccagtccccagaagaccatgtctg

SEQ ID NO: 2121 - DNA, 20 bp, Artificial Sequence
  Synthetic oligonucleotide
cttgcctggcttcacagata

SEQ ID NO: 2122 - DNA, 19 bp, Artificial Sequence
  Synthetic oligonucleotide
gggccaaatattcagaagc

SEQ ID NO: 2123 - DNA, 20 bp, Artificial Sequence
  Synthetic oligonucleotide
ccaccatagcggccatggag

SEQ ID NO: 2124 - DNA, 20 bp, Artificial Sequence
  Synthetic oligonucleotide
ggatgggtatgatgggacag

SEQ ID NO: 2125 - DNA, 20 bp, Artificial Sequence
  Synthetic oligonucleotide
gcggacttaatgcagagaca

SEQ ID NO: 2126 - DNA, 24 bp, Artificial Sequence
  Synthetic oligonucleotide
cagtatgacccacctccaggagcc

SEQ ID NO: 2127 - DNA, 20 bp, Artificial Sequence
  Synthetic oligonucleotide
tcaagtcccaaaatgttgct

SEQ ID NO: 2128 - DNA, 21 bp, Artificial Sequence
  Synthetic oligonucleotide
gacgctggtctggtgaagatg

SEQ ID NO: 2129 - DNA, 23 bp, Artificial Sequence
  Synthetic oligonucleotide
ccaggaaaccacgagcctccagc

SEQ ID NO: 2130 - DNA, 20 bp, Artificial Sequence
  Synthetic oligonucleotide
tgggtggttgttggacaatg

SEQ ID NO: 2131 - DNA, 22 bp, Artificial Sequence
  Synthetic oligonucleotide
cttcacagtgctcctgcagtct

SEQ ID NO: 2132 - DNA, 26 bp, Artificial Sequence
  Synthetic oligonucleotide
aagtacacgtaagttacagccacaca

SEQ ID NO: 2133 - DNA, 21 bp, Artificial Sequence
  Synthetic oligonucleotide
catctgcttcagctcgttggt

SEQ ID NO: 2134 - DNA, 18 bp, Artificial Sequence
  Synthetic oligonucleotide
gcctcggtgtgcctttca

SEQ ID NO: 2135 - DNA, 22 bp, Artificial Sequence
  Synthetic oligonucleotide
catcgccagctacgccctgctc

SEQ ID NO: 2136 - DNA, 19 bp, Artificial Sequence
  Synthetic oligonucleotide
cgtgatgtgcgcaatcatg

SEQ ID NO: 2137 - DNA, 19 bp, Artificial Sequence
  Synthetic oligonucleotide
ggagccggatgcagtagga

SEQ ID NO: 2138 - DNA, 23 bp, Artificial Sequence
  Synthetic oligonucleotide
accacggatatggcccgagtcca

SEQ ID NO: 2139 - DNA, 22 bp, Artificial Sequence
  Synthetic oligonucleotide
aagtccatgaaaggcatgttga

SEQ ID NO: 2140 - DNA, 19 bp, Artificial Sequence
  Synthetic oligonucleotide
tgtcaccccgactcaacgt

SEQ ID NO: 2141 - DNA, 21 bp, Artificial Sequence
  Synthetic oligonucleotide
agacgcaccgcccggactcac

SEQ ID NO: 2142 - DNA, 22 bp, Artificial Sequence
  Synthetic oligonucleotide
acgtggactgagatgcattcac

SEQ ID NO: 2143 - DNA, 20 bp, Artificial Sequence
  Synthetic oligonucleotide
cgaggacgaggcttaaaaac

SEQ ID NO: 2144 - DNA, 29 bp, Artificial Sequence
  Synthetic oligonucleotide
tctcagatcaatcgtgcatccttagtgaa

SEQ ID NO: 2145 - DNA, 20 bp, Artificial Sequence
  Synthetic oligonucleotide
accatgcttgaggacaacag

SEQ ID NO: 2146 - DNA, 19 bp, Artificial Sequence
  Synthetic oligonucleotide
gtatcaccatcaatgcggc

SEQ ID NO: 2147 - DNA, 24 bp, Artificial Sequence
  Synthetic oligonucleotide
catgtggagtatagcactgccgcc

SEQ ID NO: 2148 - DNA, 20 bp, Artificial Sequence
  Synthetic oligonucleotide
cagtctgtgtgggcgtagtg

SEQ ID NO: 2149 - DNA, 22 bp, Artificial Sequence
  Synthetic oligonucleotide
tgtgtatagtcctgcccctcaa

SEQ ID NO: 2150 - DNA, 26 bp, Artificial Sequence
  Synthetic oligonucleotide
ccggattatccgacatcttactgtga

SEQ ID NO: 2151 - DNA, 20 bp, Artificial Sequence
  Synthetic oligonucleotide
cccgatccattcccctttta

SEQ ID NO: 2152 - DNA, 20 bp, Artificial Sequence
  Synthetic oligonucleotide
ggaggagctaaatgcctcag

SEQ ID NO: 2153 - DNA, 24 bp, Artificial Sequence
  Synthetic oligonucleotide
actcatcaatgggcagagtgcacc

SEQ ID NO: 2154 - DNA, 20 bp, Artificial Sequence
  Synthetic oligonucleotide
ccttcaagtggatggtgttg

SEQ ID NO: 2155 - DNA, 18 bp, Artificial Sequence
  Synthetic oligonucleotide
gagtcgaccctgcacctg

SEQ ID NO: 2156 - DNA, 23 bp, Artificial Sequence
  Synthetic oligonucleotide
aattaacagccacccctcaggcg

SEQ ID NO: 2157 - DNA, 18 bp, Artificial Sequence
  Synthetic oligonucleotide
gcgaatgccatgactgaa

SEQ ID NO: 2158 - DNA, 20 bp, Artificial Sequence
  Synthetic oligonucleotide
acgcaccctgtctgactaca

SEQ ID NO: 2159 - DNA, 24 bp, Artificial Sequence
  Synthetic oligonucleotide
catccagaaagagtccaccctgca

SEQ ID NO: 2160 - DNA, 20 bp, Artificial Sequence
  Synthetic oligonucleotide
acctctaagacggagcacca

SEQ ID NO: 2161 - DNA, 20 bp, Artificial Sequence
  Synthetic oligonucleotide
tgtctggcgataaagggatt

SEQ ID NO: 2162 - DNA, 25 bp, Artificial Sequence
  Synthetic oligonucleotide
tctgccttccctgaatcagacaacc

SEQ ID NO: 2163 - DNA, 20 bp, Artificial Sequence
  Synthetic oligonucleotide
atggtccctacccatttgaa

SEQ ID NO: 2164 - DNA, 24 bp, Artificial Sequence
  Synthetic oligonucleotide
ctccataatttatggcctgcagta

SEQ ID NO: 2165 - DNA, 23 bp, Artificial Sequence
  Synthetic oligonucleotide
tcttcttggagcccaaccccgag

SEQ ID NO: 2166 - DNA, 18 bp, Artificial Sequence
  Synthetic oligonucleotide
tgcggcctccttgttcag

SEQ ID NO: 2167 - DNA, 20 bp, Artificial Sequence
  Synthetic oligonucleotide
gtgaagccaccgtcatcatg

SEQ ID NO: 2168 - DNA, 28 bp, Artificial Sequence
  Synthetic oligonucleotide
ctgaccaggaggcaaaaccttcaactga

SEQ ID NO: 2169 - DNA, 22 bp, Artificial Sequence
  Synthetic oligonucleotide
ccttccttcttatcccccaagt

SEQ ID NO: 2170 - DNA, 19 bp, Artificial Sequence
  Synthetic oligonucleotide
accatgctccagaaggagg

SEQ ID NO: 2171 - DNA, 24 bp, Artificial Sequence
  Synthetic oligonucleotide
ccccgagccttctacaaagggttc

SEQ ID NO: 2172 - DNA, 18 bp, Artificial Sequence
  Synthetic oligonucleotide
aacccaagcggagaaagg

SEQ ID NO: 2173 - DNA, 19 bp, Artificial Sequence
  Synthetic oligonucleotide
ccatgcagcctggaatttg

SEQ ID NO: 2174 - DNA, 25 bp, Artificial Sequence
  Synthetic oligonucleotide
ctacccagtgccccaacccattctc

SEQ ID NO: 2175 - DNA, 18 bp, Artificial Sequence
  Synthetic oligonucleotide
gagaggcctgggcacgta

SEQ ID NO: 2176 - DNA, 18 bp, Artificial Sequence
  Synthetic oligonucleotide
tgcggaaatgagctccac

SEQ ID NO: 2177 - DNA, 24 bp, Artificial Sequence
  Synthetic oligonucleotide
ccctggccactggggactacacta

SEQ ID NO: 2178 - DNA, 19 bp, Artificial Sequence
  Synthetic oligonucleotide
cctcagccattctaaccgc

SEQ ID NO: 2179 - DNA, 19 bp, Artificial Sequence
  Synthetic oligonucleotide
gacagctgatccaggagcc

SEQ ID NO: 2180 - DNA, 24 bp, Artificial Sequence
  Synthetic oligonucleotide
cgggtcctgcacttcaaggacagt

SEQ ID NO: 2181 - DNA, 18 bp, Artificial Sequence
  Synthetic oligonucleotide
atggataggcgcaggttg

SEQ ID NO: 2182 - DNA, 18 bp, Artificial Sequence
  Synthetic oligonucleotide
agaacggaggccgtgact

SEQ ID NO: 2183 - DNA, 24 bp, Artificial Sequence
  Synthetic oligonucleotide
cgggacgctgctcgactctaagaa

SEQ ID NO: 2184 - DNA, 18 bp, Artificial Sequence
  Synthetic oligonucleotide
catgcacagcccatctgt

SEQ ID NO: 2185 - DNA, 20 bp, Artificial Sequence
  Synthetic oligonucleotide
ctgaacacagtggagctggt

SEQ ID NO: 2186 - DNA, 22 bp, Artificial Sequence
  Synthetic oligonucleotide
acctgccgcacacagagtttgc

SEQ ID NO: 2187 - DNA, 20 bp, Artificial Sequence
  Synthetic oligonucleotide
ctggaagatctgcccttctc

SEQ ID NO: 2188 - DNA, 19 bp, Artificial Sequence
  Synthetic oligonucleotide
gtggatgtgccctgaagga

SEQ ID NO: 2189 - DNA, 28 bp, Artificial Sequence
  Synthetic oligonucleotide
aagccaggcgtctacacgagagtctcac

SEQ ID NO: 2190 - DNA, 20 bp, Artificial Sequence
  Synthetic oligonucleotide
ctgcggatccagggtaagaa

SEQ ID NO: 2191 - DNA, 18 bp, Artificial Sequence
  Synthetic oligonucleotide
acgggtcctgcctcagtt

SEQ ID NO: 2192 - DNA, 24 bp, Artificial Sequence
  Synthetic oligonucleotide
tcagctttctctgcattggctccc

SEQ ID NO: 2193 - DNA, 18 bp, Artificial Sequence
  Synthetic oligonucleotide
cggggcaatcattgtgac

SEQ ID NO: 2194 - DNA, 21 bp, Artificial Sequence
  Synthetic oligonucleotide
tggcttcaggagctgaatacc

SEQ ID NO: 2195 - DNA, 26 bp, Artificial Sequence
  Synthetic oligonucleotide
caggcacacacaggtgggacacaaat

SEQ ID NO: 2196 - DNA, 24 bp, Artificial Sequence
  Synthetic oligonucleotide
tgctgtcgtgatgagaaaatagtg

SEQ ID NO: 2197 - DNA, 23 bp, Artificial Sequence
  Synthetic oligonucleotide
gataccacaactcccatcaagct

SEQ ID NO: 2198 - DNA, 18 bp, Artificial Sequence
  Synthetic oligonucleotide
agtggcagccacggcgcc

SEQ ID NO: 2199 - DNA, 19 bp, Artificial Sequence
  Synthetic oligonucleotide
tccctgttaggcgcatcag

SEQ ID NO: 2200 - DNA, 19 bp, Artificial Sequence
  Synthetic oligonucleotide
ggctttggcagcttcagat

SEQ ID NO: 2201 - DNA, 23 bp, Artificial Sequence
  Synthetic oligonucleotide
agctccaccctggttccctgaag

SEQ ID NO: 2202 - DNA, 18 bp, Artificial Sequence
  Synthetic oligonucleotide
ctccactgccctgactgg

SEQ ID NO: 2203 - DNA, 19 bp, Artificial Sequence
  Synthetic oligonucleotide
gctgcgacatggatttcga

SEQ ID NO: 2204 - DNA, 20 bp, Artificial Sequence
  Synthetic oligonucleotide
ttgctgggccttccatccgg

SEQ ID NO: 2205 - DNA, 20 bp, Artificial Sequence
  Synthetic oligonucleotide
ccagccctcgtaacctagca

SEQ ID NO: 2206 - DNA, 18 bp, Artificial Sequence
  Synthetic oligonucleotide
acccacggacagacttgc

SEQ ID NO: 2207 - DNA, 24 bp, Artificial Sequence
  Synthetic oligonucleotide
cgcgtccaatgtgtattcctccat

SEQ ID NO: 2208 - DNA, 18 bp, Artificial Sequence
  Synthetic oligonucleotide
agctttgccaaggtcagc

SEQ ID NO: 2209 - DNA, 20 bp, Artificial Sequence
  Synthetic oligonucleotide
gccctggatttcagaaagag

SEQ ID NO: 2210 - DNA, 25 bp, Artificial Sequence
  Synthetic oligonucleotide
caagtctggatctgggaccctttcc

SEQ ID NO: 2211 - DNA, 20 bp, Artificial Sequence
  Synthetic oligonucleotide
agttacaagccagggaagga

SEQ ID NO: 2212 - DNA, 20 bp, Artificial Sequence
  Synthetic oligonucleotide
ctgctgtcttgggtgcattg

SEQ ID NO: 2213 - DNA, 25 bp, Artificial Sequence
  Synthetic oligonucleotide
ttgccttgctgctctacctccacca

SEQ ID NO: 2214 - DNA, 18 bp, Artificial Sequence
  Synthetic oligonucleotide
gcagcctgggaccacttg

SEQ ID NO: 2215 - DNA, 23 bp, Artificial Sequence
  Synthetic oligonucleotide
tgtgaatgcagaccaaagaaaga

SEQ ID NO: 2216 - DNA, 28 bp, Artificial Sequence
  Synthetic oligonucleotide
agagcaagacaagaaaatccctgtgggc

SEQ ID NO: 2217 - DNA, 20 bp, Artificial Sequence
  Synthetic oligonucleotide
gctttctccgctctgagcaa

SEQ ID NO: 2218 - DNA, 22 bp, Artificial Sequence
  Synthetic oligonucleotide
agcttcctacagcacaacaaat

SEQ ID NO: 2219 - DNA, 29 bp, Artificial Sequence
  Synthetic oligonucleotide
tgtcttgctctatctttctttggtctgca

SEQ ID NO: 2220 - DNA, 20 bp, Artificial Sequence
  Synthetic oligonucleotide
ctcggcttgtcacatttttc

SEQ ID NO: 2221 - DNA, 19 bp, Artificial Sequence
  Synthetic oligonucleotide
tgacgatggcctggagtgt

SEQ ID NO: 2222 - DNA, 21 bp, Artificial Sequence
  Synthetic oligonucleotide
ctgggcagcaccaagtccgga

SEQ ID NO: 2223 - DNA, 22 bp, Artificial Sequence
  Synthetic oligonucleotide
ggtaccggatcatgaggatctg

SEQ ID NO: 2224 - DNA, 25 bp, Artificial Sequence
  Synthetic oligonucleotide
cctcagcaagacgttatttgaaatt

SEQ ID NO: 2225 - DNA, 26 bp, Artificial Sequence
  Synthetic oligonucleotide
cctctctctcaaggccccaaaccagt

SEQ ID NO: 2226 - DNA, 24 bp, Artificial Sequence
  Synthetic oligonucleotide
aagtgtgattggcaaaactgattg

SEQ ID NO: 2227 - DNA, 21 bp, Artificial Sequence
  Synthetic oligonucleotide
tgcccttaaaggaaccaatga

SEQ ID NO: 2228 - DNA, 22 bp, Artificial Sequence
  Synthetic oligonucleotide
atttcacgcatctggcgttcca

SEQ ID NO: 2229 - DNA, 22 bp, Artificial Sequence
  Synthetic oligonucleotide
gcttcaacggcaaagttctctt

SEQ ID NO: 2230 - DNA, 19 bp, Artificial Sequence
  Synthetic oligonucleotide
tacaagctgagtgcccagg

SEQ ID NO: 2231 - DNA, 24 bp, Artificial Sequence
  Synthetic oligonucleotide
tacaaaagcctccatttcggcacc

SEQ ID NO: 2232 - DNA, 19 bp, Artificial Sequence
  Synthetic oligonucleotide
cactcgcagatgcgtcttt

SEQ ID NO: 2233 - DNA, 22 bp, Artificial Sequence
  Synthetic oligonucleotide
agaggcatccatgaacttcaca

SEQ ID NO: 2234 - DNA, 20 bp, Artificial Sequence
  Synthetic oligonucleotide
cgggctgcatcagcacacgc

SEQ ID NO: 2235 - DNA, 24 bp, Artificial Sequence
  Synthetic oligonucleotide
caaactccacagtacttgggttga

SEQ ID NO: 2236 - DNA, 20 bp, Artificial Sequence
  Synthetic oligonucleotide
acaaagctaccagggagtcg

SEQ ID NO: 2237 - DNA, 22 bp, Artificial Sequence
  Synthetic oligonucleotide
tttgtccacgccattgcctcag

SEQ ID NO: 2238 - DNA, 19 bp, Artificial Sequence
  Synthetic oligonucleotide
tgagcgtgtcactgcaaag

SEQ ID NO: 2239 - DNA, 25 bp, Artificial Sequence
  Synthetic oligonucleotide
gtatcaggaccacatgcagtacatc

SEQ ID NO: 2240 - DNA, 24 bp, Artificial Sequence
  Synthetic oligonucleotide
ttgatgcctgtcttcgcgccttct

SEQ ID NO: 2241 - DNA, 22 bp, Artificial Sequence
  Synthetic oligonucleotide
tgtcggaattgatactggcatt

SEQ ID NO: 2242 - DNA, 20 bp, Artificial Sequence
  Synthetic oligonucleotide
tgtcttcagggtcttgtcca

SEQ ID NO: 2243 - DNA, 24 bp, Artificial Sequence
  Synthetic oligonucleotide
ttccgtaagaggcctggtgctctc

SEQ ID NO: 2244 - DNA, 20 bp, Artificial Sequence
  Synthetic oligonucleotide
gtgcacgtggatgaaagagt

SEQ ID NO: 2245 - DNA, 18 bp, Artificial Sequence
  Synthetic oligonucleotide
cggtggaatctggctctg

SEQ ID NO: 2246 - DNA, 24 bp, Artificial Sequence
  Synthetic oligonucleotide
ctccctctgctcttgacctggctc

SEQ ID NO: 2247 - DNA, 20 bp, Artificial Sequence
  Synthetic oligonucleotide
ccatgaagagttgacctcgg

SEQ ID NO: 2248 - DNA, 19 bp, Artificial Sequence
  Synthetic oligonucleotide
atcgcagctggtgggtgta

SEQ ID NO: 2249 - DNA, 26 bp, Artificial Sequence
  Synthetic oligonucleotide
ctgctgtttaccttggcgaggccttt

SEQ ID NO: 2250 - DNA, 21 bp, Artificial Sequence
  Synthetic oligonucleotide
agctccctgttgcatggactt

SEQ ID NO: 2251 - DNA, 20 bp, Artificial Sequence
  Synthetic oligonucleotide
gggtagagggaaaagggttc

SEQ ID NO: 2252 - DNA, 29 bp, Artificial Sequence
  Synthetic oligonucleotide
caaaggctgaactggattcttaaccaaga

SEQ ID NO: 2253 - DNA, 21 bp, Artificial Sequence
  Synthetic oligonucleotide
tgcaccaccattgctattatt

SEQ ID NO: 2254 - DNA, 20 bp, Artificial Sequence
  Synthetic oligonucleotide
gatacatcgtctgcgaggaa

SEQ ID NO: 2255 - DNA, 24 bp, Artificial Sequence
  Synthetic oligonucleotide
ttcaaagacgtgctcctgactgcc

SEQ ID NO: 2256 - DNA, 20 bp, Artificial Sequence
  Synthetic oligonucleotide
ctttcaatgactgcctgctc

SEQ ID NO: 2257 - DNA, 18 bp, Artificial Sequence
  Synthetic oligonucleotide
ggagatgaagcccccaag

SEQ ID NO: 2258 - DNA, 24 bp, Artificial Sequence
  Synthetic oligonucleotide
agaagcaaccccagaccaaaacca

SEQ ID NO: 2259 - DNA, 18 bp, Artificial Sequence
  Synthetic oligonucleotide
gtccagctgcctgagtgg

SEQ ID NO: 2260 - DNA, 25 bp, Artificial Sequence
  Synthetic oligonucleotide
agactgtggagtttgatgttgttga

SEQ ID NO: 2261 - DNA, 23 bp, Artificial Sequence
  Synthetic oligonucleotide
ttgctgcctccgcacccttttct

SEQ ID NO: 2262 - DNA, 22 bp, Artificial Sequence
  Synthetic oligonucleotide
ggaacaccaccaggacctgtaa

SEQ ID NO: 2263 - DNA, 18 bp, Artificial Sequence
  Synthetic oligonucleotide
catggcctccgctatgaa

SEQ ID NO: 2264 - DNA, 24 bp, Artificial Sequence
  Synthetic oligonucleotide
aggttcattcagctctgtcaccgc

SEQ ID NO: 2265 - DNA, 22 bp, Artificial Sequence
  Synthetic oligonucleotide
ggagatttcgatcttcattgga

SEQ ID NO: 2266 - DNA, 18 bp, Artificial Sequence
  Synthetic oligonucleotide
ctgcgttcacaccccagt

SEQ ID NO: 2267 - DNA, 24 bp, Artificial Sequence
  Synthetic oligonucleotide
tctctccagaacagctcgccctgt

SEQ ID NO: 2268 - DNA, 19 bp, Artificial Sequence
  Synthetic oligonucleotide
ctcagccacgacagatggt

SEQ ID NO: 2269 - DNA, 19 bp, Artificial Sequence
  Synthetic oligonucleotide
tgctgagcctcctctcctt

SEQ ID NO: 2270 - DNA, 24 bp, Artificial Sequence
  Synthetic oligonucleotide
tactcctcatcacagtgcccctgc

SEQ ID NO: 2271 - DNA, 21 bp, Artificial Sequence
  Synthetic oligonucleotide
ggatgggggttagtgataagg

SEQ ID NO: 2272 - DNA, 78 bp, Homo sapiens
  Synthetic oligonucleotide
cgttccgatcctctatactgcatcccaggcatgcctacagcaccctgatgtcgcagcctataaggccaacagggacct

SEQ ID NO: 2273 - DNA, 77 bp, Homo sapiens
aaacaccactggagcattgactaccaggctcgccaatgatgctgctcaagttaaaggggctataggttccaggcttg

SEQ ID NO: 2274 - DNA, 76 bp, Homo sapiens
tgcagactgtaccatgctgaccattgcccatcgcctgcacacggttctaggctccgataggattatggtgctggcc

SEQ ID NO: 2275 - DNA, 71 bp, Homo sapiens
ggatgaacctcgacctgctgcaggagcactcggacgaggctatctgggcagccctggagacggtgcagctc

SEQ ID NO: 2276 - DNA, 69 bp, Homo sapiens
gctaccaagtccgtgctgtttgtgtgtctgggtaacatttgtcgatcacccattgcagaagcagttttc

SEQ ID NO: 2277 - DNA, 67 bp, Homo sapiens
cccatcaacttgtgccagtacagggtctgtgcagtggagtaggcacttcagtggtcgaaccatcacc

SEQ ID NO: 2278 - DNA, 73 bp, Homo sapiens
gaagtgccaggaggcgattaatgctacttgcaaaggcgtgtcctactgcacaggtaatagcagtgagtgcccg

SEQ ID NO: 2279 - DNA, 66 bp, Homo sapiens
ggagaagggtggagtgcagcacccagatggattctgactgtgcggccatccagagacctgaccctg

SEQ ID NO: 2280 - DNA, 76 bp, Homo sapiens
ttgacaacctgctggacatcgaggtggcctacagtctgctcaggggagggtctgatgatagcagcaaggatcccat

SEQ ID NO: 2281 - DNA, 66 bp, Homo sapiens
cttttccctccagtggcacctcctggaaacagtccacttgggcgcaaaacccagtgccttccaaat

SEQ ID NO: 2282 - DNA, 75 bp, Homo sapiens
tagagagcccctgacaatcctgaggcttcatcaggagctagagccatttaacatttcctctttccaagaccaacc

SEQ ID NO: 2283 - DNA, 71 bp, Homo sapiens
cgcttctatggcgctgagattgtgtcagccctggactacctgcactcggagaagaacgtggtgtaccggga

SEQ ID NO: 2284 - DNA, 71 bp, Homo sapiens
tcctgccacccttcaaacctcaggtcacgtccgaggtcgacacaaggtacttcgatgatgaatttaccgcc

SEQ ID NO: 2285 - DNA, 75 bp, Homo sapiens
ttgtctctgccttggactatctacattccggaaagattgtgtaccgtgatctcaagttggagaatctaatgctgg

SEQ ID NO: 2286 - DNA, 67 bp, Homo sapiens
caagaagaggctctaccctgggactgggaatttccaaggccacctttgaggatcgcagagctcattt

SEQ ID NO: 2287 - DNA, 66 bp, Homo sapiens
gaggaatatggaatccaagggggccagttcctgccgtctgctcttctgcctcttgatctccgccac

SEQ ID NO: 2288 - DNA, 74 bp, Homo sapiens
gaaggagataaggaggatgttgacaaggcagtgaaggccgcaagacaggcttttcagattggatctccgtggcg

SEQ ID NO: 2289 - DNA, 69 bp, Homo sapiens
gcctgtacgtgccagctccccgactgccagagcctcaactgtctctgcttcgagatcaagctccgatga

SEQ ID NO: 2290 - DNA, 76 bp, Homo sapiens
gatggttcagctctgcaaggatcgatttgaatatctttccttctcgcccaccacgccgatgagcagccacggtcga

SEQ ID NO: 2291 - DNA, 69 bp, Homo sapiens
ccgtgaaagctgctctgtaaaagctgacacagccctcccaagtgagcaggactgttcttcccactgcaa

SEQ ID NO: 2292 - DNA, 67 bp, Homo sapiens
ctccaggtgtacctccaaccctagccttctcccacagctgcctacaacagagtctcccagccttctc

SEQ ID NO: 2293 - DNA, 67 bp, Homo sapiens
gcccctatcctaccttcaatccatcctcggatgtcgctgccttgcataaggccataatggttaaagg

SEQ ID NO: 2294 - DNA, 71 bp, Homo sapiens
caagacactaagggcgactaccagaaagcgctgctgtacctgtgtggtggagatgactgaagcccgacacg

SEQ ID NO: 2295 - DNA, 67 bp, Homo sapiens
gctcaagcctggaagatgacgtggtgggggacacttcagggtactaccagcggatgttggtggttct

SEQ ID NO: 2296 - DNA, 81 bp, Homo sapiens
gactgcaaagatggaaacgaccttctatgacgatgccctcaacgcctcgttcctcccgtccgagagcggaccttatggcta

SEQ ID NO: 2297 - DNA, 69 bp, Homo sapiens
ggacagcaggaatgtgtttctccatacaggtcacggggagccaatggttcagaaacaaatcgagtgggt

SEQ ID NO: 2298 - DNA, 68 bp, Homo sapiens
gatgaagcctttcgcaagttcctgaagggcctggcttcccgaaagccccttgtgctgtgtggagacct

SEQ ID NO: 2299 - DNA, 67 bp, Homo sapiens
accccggcctgtatatcattgggatcaagaactcgagccattggaaatgcagcaaagagccagatag

SEQ ID NO: 2300 - DNA, 83 bp, Homo sapiens
ccaccttggaccaaagtaaagcgtggaatcgttaccgcctccccaacacgctgaaacccgattcctaccaggtgacgctgaga

SEQ ID NO: 2301 - DNA, 74 bp, Homo sapiens
ggaaacacactggaggacaaggctcgggaactcatcagccgcatcaaacagagtgaactttctgccaagatgcg

SEQ ID NO: 2302 - DNA, 82 bp, Homo sapiens
tgtgagtgaaatgccttctagtagtgaaccgtcctcgggagccgactatgactactcagaagagtatgataacgaaccacaa

SEQ ID NO: 2303 - DNA, 80 bp, Homo sapiens
cgcagtgcagctgagtatctgctcagcagtctaatcaatggcagcttcctggtgcgagaaagtgagagtagccctgggca

SEQ ID NO: 2304 - DNA, 74 bp, Homo sapiens
actggcccacttagtcctcaagctcccaacctgctgtccctcaagccccgcttctaccagcctgtggagttcag

SEQ ID NO: 2305 - DNA, 66 bp, Homo sapiens
gcagccacctgcaactttgcaggcgagagagcatcccgtctacccgcctgagctgtccctcctgga

SEQ ID NO: 2306 - DNA, 65 bp, Homo sapiens
gatgctgccactcaacaacttttgagtcgtggcgtgcgtctaactgagttgctgaagcaaggaca

SEQ ID NO: 2307 - DNA, 66 bp, Homo sapiens
ccgctttcgctacagcatggtggcctactggagacaggctggactcagctacatccgatactccca

SEQ ID NO: 2308 - DNA, 67 bp, Homo sapiens
agctgcagaagagctgcacatttgacgagcagcgaacagccacgatcatggaggagttggcagatgc

SEQ ID NO: 2309 - DNA, 66 bp, Homo sapiens
ggctatgtctttgcaccagccaccagcgccaacgacagtgagatatccagtgatgcgctgacggat

SEQ ID NO: 2310 - DNA, 68 bp, Homo sapiens
ccgtgtgacagcatcgttgtggcgtactacttctgcggggaacccatcccctaccgcaccctggtgag

SEQ ID NO: 2311 - DNA, 80 bp, Homo sapiens
ggctcttgtgcgtactgtccttcgggctggtgacagggaagacatcactgagcctgccatctgtgctcttcgtcatctga

SEQ ID NO: 2312 - DNA, 73 bp, Homo sapiens
gggtcaggtgcctcgagatcgggcttgggcccagagcatgttccagatcccagagtttgagccgagtgagcag

SEQ ID NO: 2313 - DNA, 81 bp, Homo sapiens
cgttgtcagcacttggaatacaagatggttgccgggtcatgttaattgggaaaaagaacagtccacaggaagaggttgaac

SEQ ID NO: 2314 - DNA, 69 bp, Homo sapiens
ctaggggcaaaaagcatgactgctttttcctgtctggcatggaatcacgcagtcaccttgggcatttag

SEQ ID NO: 2315 - DNA, 74 bp, Homo sapiens
gaaagtaagccaggcccagttggaccagaactccctcctggacacatcccaattcaagtgatccgcaaagaggt

SEQ ID NO: 2316 - DNA, 66 bp, Homo sapiens
ccattcccaccattctacctgaggccaggacgtctggggtgtggggattggtgggtctatgttccc

SEQ ID NO: 2317 - DNA, 70 bp, Homo sapiens
ccgccgtggacacagactccccccgagaggtctttttccgagtggcagctgacatgttttctgacggcaa

SEQ ID NO: 2318 - DNA, 83 bp, Homo sapiens
cctggagggtcctgtacaatctcatcatgggactcctgcccttacccaggggccacagagcccccgagatggagcccaattag

SEQ ID NO: 2319 - DNA, 73 bp, Homo sapiens
ccccgagacaacggagataagtgctgttgcggatgccaacggaaagaatcttgggaaagaggccaaacccgag

SEQ ID NO: 2320 - DNA, 73 bp, Homo sapiens
cagatggacctagtacccactgagatttccacgccgaaggacagcgatgggaaaaatgcccttaaatcatagg

SEQ ID NO: 2321 - DNA, 73 bp, Homo sapiens
gctgggatggcttttgtcacttcttcaggaccccctttccactggctttttggagaaaacagctggtccaggc

SEQ ID NO: 2322 - DNA, 69 bp, Homo sapiens
aattaccaagcagccgaagaccacccacgaatggttatcttacgactgttacgttacattgtccgcctg

SEQ ID NO: 2323 - DNA, 73 bp, Homo sapiens
aacccacccctgtcttggagctccgggtagctctcaaactcgaggctgcgcaccccctttcccgtcagctgag

SEQ ID NO: 2324 - DNA, 70 bp, Homo sapiens
cttttgtggaactctatgggaacaatgcagcagccgagagccgaaagggccaggaacgcttcaaccgctg

SEQ ID NO: 2325 - DNA, 74 bp, Homo sapiens
tgtactggcgaagaatatttggtaaagcagggcatcgatctctcaccctggggcttgtggaagaatcacgtggc

SEQ ID NO: 2326 - DNA, 77 bp, Homo sapiens
ccaggaagaatgcttaagatgtgagtggatggatctcaatgacctggcgaagactgaaaatacaactcccatcacca

SEQ ID NO: 2327 - DNA, 66 bp, Homo sapiens
gagctccgcaaggatgacttcaagggtctccagcacctctacgccctcgtcctggtgaacaacaag

SEQ ID NO: 2328 - DNA, 71 bp, Homo sapiens
ggactgtgaggtcaacaacggttccagcctcagggatgagtgcatcacaaacctactggtgtttggcttcc

SEQ ID NO: 2329 - DNA, 70 bp, Homo sapiens
attcctatggctctgcaattgtcaccggttaactgtggcctgtgcccaggaagagccattcactcctgcc

SEQ ID NO: 2330 - DNA, 76 bp, Homo sapiens
cctgcaaaagggaacaagagcccttcgcctccagatggctcccctgccgccacccccgagatcagagtcaaccacg

SEQ ID NO: 2331 - DNA, 77 bp, Homo sapiens
ggttgctgcctccatcaaagatggagaggctgtgtggtttggctgtgatgttggaaaacacttcaatagcaagctgg

SEQ ID NO: 2332 - DNA, 77 bp, Homo sapiens
atgtggacgctctttcaatggacgtgtccccgcgtgcttcttagacggactgcggtctcctaaaggtcgaccatggt

SEQ ID NO: 2333 - DNA, 69 bp, Homo sapiens
gggctagccattgaggtgactcacctccatcagactcggacccaccagggccagcatgtcaggattagc

SEQ ID NO: 2334 - DNA, 69 bp, Homo sapiens
tcgtggaacatgacaaggaattcttccacccacgctaccaccatcgagagttccggtttgatctttcca

SEQ ID NO: 2335 - DNA, 68 bp, Homo sapiens
ttggttcagcgaactattgccaaacagattcagatggtccggcaagttggtaaaggccgatatggaga

SEQ ID NO: 2336 - DNA, 82 bp, Homo sapiens
ccttccgaccagcagatgaagatcatcgaaatcaatttgggcaacgagaccgatcctcatcagctcccaatgtgcatataaa

SEQ ID NO: 2337 - DNA, 65 bp, Homo sapiens
tcagggggctagaaatctgttgctatgggcccttcaccaacatgcccacagatcaactggaatgg

SEQ ID NO: 2338 - DNA, 70 bp, Homo sapiens
agttcgtgctttgcaagatggtgcagagctttatgaagcagtgaagaatgcagcagacccagcttacctt

SEQ ID NO: 2339 - DNA, 79 bp, Homo sapiens
gtgcaggaaaggttcacaaatgtggagtgtctgcgtccaatacacgcgtgtgctcctctccttactccatcgtgtgtgc

SEQ ID NO: 2340 - DNA, 74 bp, Homo sapiens
cagtgatccactttaacaaccctaaagttcaggcatctctggcagcgaacactttcaccattacaggccatgct

SEQ ID NO: 2341 - DNA, 63 bp, Homo sapiens
gttgggacacagttggtctgcagtcggcccaggacggtctactcagcacaactgactgcttca

SEQ ID NO: 2342 - DNA, 68 bp, Homo sapiens
ccgaggttaatccagcacgtatggggccaagtgtaggctcccagcaggaactgagagcgccatgtctt

SEQ ID NO: 2343 - DNA, 82 bp, Homo sapiens
tcaacagaaggctgaaccactagaaagactacagtcccagcaccgacaattccaagctcgagtgtctcggcaaactctgttg

SEQ ID NO: 2344 - DNA, 73 bp, Homo sapiens
ctgaagcagatggttcatcatttcctgggctgttaaacaaagcgaggttaaggttagactcttgggaatcagc

SEQ ID NO: 2345 - DNA, 75 bp, Homo sapiens
ccatctcgctgagatacgaagggagggtgtaccattacaggatcaacactgcttctgatggcaagctctacgtct

SEQ ID NO: 2346 - DNA, 75 bp, Homo sapiens
gaggcaactgcttatggcttaattaagtcagatgcggccatgactgtcgctgtaaagatgctcaagccgagtgcc

SEQ ID NO: 2347 - DNA, 87 bp, Homo sapiens
aactcagacttggaaatgccttctttaacttccacccccctcattggtcacaaattgactgttacaacaccatttcatagagaccag

SEQ ID NO: 2348 - DNA, 74 bp, Homo sapiens
tgaggagtggtattttggcaagatcaccagacgggagtcagagcggttactgctcaatgcagagaacccgagag

SEQ ID NO: 2349 - DNA, 65 bp, Homo sapiens
tcagctgtgagctgcggataccgcccggcaatgggacctgctcttaacctcaaacctaggaccgt

SEQ ID NO: 2350 - DNA, 67 bp, Homo sapiens
ccagcactgctcgttactgtctgccttcagtggtctgaggtcccagtatgaactgccgtgaagtcaa

SEQ ID NO: 2351 - DNA, 67 bp, Homo sapiens
ctacgagtcagcccatccatccatggctaccacttcgacacagcctctcgtaagaaagccgtgggca

SEQ ID NO: 2352 - DNA, 72 bp, Homo sapiens
atcctagccctggtttttggcctcctttttgctgtcaccagcgtcgcgttccttgtgcagatgagaaggcag

SEQ ID NO: 2353 - DNA, 77 bp, Homo sapiens
gaaggccaagaaccgagtcaaattatattccagtttaaggccaatcctcctgctgtgacttttgaactaactgggga

SEQ ID NO: 2354 - DNA, 78 bp, Homo sapiens
cactaaggtttgagacagttccagaaagaacccaagctcaagacgcaggacgagctcagttgtagagggctaattcgc

SEQ ID NO: 2355 - DNA, 68 bp, Homo sapiens
gattgtcactgatggggaggagcctgctgagatgatccaggtcctgggccccaagcctgctctgaagg

SEQ ID NO: 2356 - DNA, 79 bp, Homo sapiens
caagaagctgtacgagctcatcatcacccgctactcggagcccgacctggcggtcgactttgacaatttcgtttgctgc

SEQ ID NO: 2357 - DNA, 70 bp, Homo sapiens
cctcggggatactgtctgatcatcaacaatcacaattttgcaaaagcacgggagaaagtgcccaaacttc

SEQ ID NO: 2358 - DNA, 77 bp, Homo sapiens
tgaatgccgtggattgcacgtggcctcttgagcagtggctggtccagggctagtgacttgtgtcccatgatccctgt

SEQ ID NO: 2359 - DNA, 78 bp, Homo sapiens
atccattcgatctcaccaaggtttggcctcacaaggactaccctctcatcccagttggtaaactggtcttaaaccgga

SEQ ID NO: 2360 - DNA, 74 bp, Homo sapiens
gtggctcaacattgtgttcccatttcagctgatcagtgggcctccaaggaggggctgtaaaatggaggccattg

SEQ ID NO: 2361 - DNA, 72 bp, Homo sapiens
tcattcacaaacctggcagttatatcttccggctgagctgtactcgtctgggtcagtgggctattgggtatg

SEQ ID NO: 2362 - DNA, 69 bp, Homo sapiens
ccatgtgctgtaccaagagtttgctcctggctgctttgatgtcagtgctgctactccacctctgcggcg

SEQ ID NO: 2363 - DNA, 77 bp, Homo sapiens
agcagacagtggtcagtcctttcttggctctgctgacactcgagcccacattccgtcacctgctcagaatcatgcag

SEQ ID NO: 2364 - DNA, 79 bp, Homo sapiens
ccatacctcaagtatttgccatcagttattgctggagctgcctttcatttagcactctacacagtcacgggacaaagct

SEQ ID NO: 2365 - DNA, 84 bp, Homo sapiens
ttcaggttgttgcaggagaccatgtacatgactgtctccattattgatcggttcatgcagaataattgtgtgcccaagaagatg

SEQ ID NO: 2366 - DNA, 73 bp, Homo sapiens
aggcttctgcaggagactctgtacatgtgcgttggcattatggatcgatttttacaggttcagccagtttccc

SEQ ID NO: 2367 - DNA, 69 bp, Homo sapiens
gcatgttcgtggcctctaagatgaaggagaccatccccctgacggccgagaagctgtgcatctacaccg

SEQ ID NO: 2368 - DNA, 76 bp, Homo sapiens
cctctgtgctacagattatacctttgccatgtacccgccatccatgatcgccacgggcagcattggggctgcagtg

SEQ ID NO: 2369 - DNA, 71 bp, Homo sapiens
aaagaagatgatgaccgggtttacccaaactcaacgtgcaagcctcggattattgcaccatccagaggctc

SEQ ID NO: 2370 - DNA, 82 bp, Homo sapiens
atgctgtggctccttcctaactggggctttcttgacatgtaggttgcttggtaataacctttttgtatatcacaatttgggt

SEQ ID NO: 2371 - DNA, 85 bp, Homo sapiens
ggtcaccaagaaacatcagtatgaaattaggaattgttggccacctgtattatctggggggatcagtccttgcattatcattgaa

SEQ ID NO: 2372 - DNA, 64 bp, Homo sapiens
ggatgacatgcactcagctcttggctccactgggatgggaggagaggacaagggaaatgtcagg

SEQ ID NO: 2373 - DNA, 75 bp, Homo sapiens
gcaggtgtcagcaagtatgatcagcaatgaggcggtggtcaatatcctgtcgagctcatcaccacagcggaaaaa

SEQ ID NO: 2374 - DNA, 72 bp, Homo sapiens
gcccagtgcggagaacaggtccagcttgattctcgtctctgcacttaagctgttctccaggtgcgtgtgatt

SEQ ID NO: 2375 - DNA, 81 bp, Homo sapiens
cgtcaggacccaccatgtctgccccatcacgcggccgagacatggcttggccacagctcttgaggatgtcaccaattaacc

SEQ ID NO: 2376 - DNA, 77 bp, Homo sapiens
tccaactaatgccaccaccaaggcggctggtggtgccctgcagtcaacagccagtctcttcgtggtctcactctctc

SEQ ID NO: 2377 - DNA, 66 bp, Homo sapiens
tgtgaaagggaaacacctttgtccaagtcccctatttcccggaccttctaagcccttttgggtgct

SEQ ID NO: 2378 - DNA, 75 bp, Homo sapiens
tgtatttcaagacctctgtgcacttatttatgaacctgccctgctcccacagaacacagcaattcctcaggctaa

SEQ ID NO: 2379 - DNA, 67 bp, Homo sapiens
ccactgcacacacctcagaggctgttcttggggccctacaccttgaggaggggcaggtaaactcctg

SEQ ID NO: 2380 - DNA, 65 bp, Homo sapiens
agatgaagtggaaggcgcttttcaccgcggccatcctgcaggcacagttgccgattacagaggca

SEQ ID NO: 2381 - DNA, 90 bp, Homo sapiens
atcaccgacagcacagacagaatccctgctaccaatatggactccagtcatagtacaacgcttcagcctactgcaaatccaaacacaggt

SEQ ID NO: 2382 - DNA, 78 bp, Homo sapiens
gacgaagacagtccctggatcaccgacagcacagacagaatccctgctaccagagaccaagacacattccaccccagt

SEQ ID NO: 2383 - DNA, 69 bp, Homo sapiens
cacacaaaacagaaccaggactggacccagtggaacccaagccattcaaatccggaagtgctacttcag

SEQ ID NO: 2384 - DNA, 78 bp, Homo sapiens
ctcataccagccatccaatgcaaggaaggacaacaccaagcccagaggacagttcctggactgatttcttcaacccaa

SEQ ID NO: 2385 - DNA, 74 bp, Homo sapiens
tggttcccagccctgtgtccacctccaagcccagattcagattcgagtcatgtacacaacccagggtggaggag

SEQ ID NO: 2386 - DNA, 71 bp, Homo sapiens
ttcagttgctttgcaggaagtgtctagaggaatatggtgggcacagaagtagctctggtgaccttgatcaa

SEQ ID NO: 2387 - DNA, 84 bp, Homo sapiens
gtgcaggctcaggtgaagtgctgcggctgggtcagcttctacaactggacagacaacgctgagctcatgaatcgccctgaggtc

SEQ ID NO: 2388 - DNA, 68 bp, Homo sapiens
agggtgaggtgcttgagtctccaacggcaagggaacaagtacttcttgatacctgggatactgtgccc

SEQ ID NO: 2389 - DNA, 64 bp, Homo sapiens
gggcgtggaacagtttatctcagacatctgccccaagaaggacgtactcgaaaccttcaccgtg

SEQ ID NO: 2390 - DNA, 68 bp, Homo sapiens
gagagcgacgcggttgttgtagctgccgctgcggccgccgcggaataataagccgggatctaccatac

SEQ ID NO: 2391 - DNA, 68 bp, Homo sapiens
tggattggagttctgggaatgtactggccgtggcactggacaacagtgtgtacctgtggagtgcaagc

SEQ ID NO: 2392 - DNA, 71 bp, Homo sapiens
tcttgctggctacgcctcttctgtccctgttagacgtcctccgtccatatcagaactgtgccacaatgcag

SEQ ID NO: 2393 - DNA, 85 bp, Homo sapiens
aaacgagcagtttgccatcagacgcttccagtctatgccggtgaggctgctgggccacagccccgtgcttcggaacatcaccaac

SEQ ID NO: 2394 - DNA, 67 bp, Homo sapiens
ggtgagcagaagtggcctatatcgctccccgtcgatgccagagaacttgaacaggccaagactgaag

SEQ ID NO: 2395 - DNA, 77 bp, Homo sapiens
gcagtccgctgtgttcaatatgatggcaggagggttgttagtggagcatatgattttatggtaaaggtgtgggatcc

SEQ ID NO: 2396 - DNA, 72 bp, Homo sapiens
tccagagactgctgaaaagctggcccgtgacctgaaggctgtcaagtatgtggagtgttctgcacttacaca

SEQ ID NO: 2397 - DNA, 67 bp, Homo sapiens
gagctgaaagacgcacactgtcagaggaaactggccatgcaggaattcatggagatcaatgagcggc

SEQ ID NO: 2398 - DNA, 67 bp, Homo sapiens
gcaacactccccatttacctccttgttctccaccaaagcaaggcaagaaagagaatggtccccctca

SEQ ID NO: 2399 - DNA, 71 bp, Homo sapiens
aagaccgtggatggctacatgaatgaagatgacctgcccagaagccgtcgctccagatcatccgtgaccct

SEQ ID NO: 2400 - DNA, 81 bp, Homo sapiens
tgagtgtcccccggtatcttccccgccctgccaatcccgatgaaattggaaattttattgatgaaaatctgaaagcggctg

SEQ ID NO: 2401 - DNA, 70 bp, Homo sapiens
gtcggcagaagcaggacttgtaccttctgcccatagtgatcagcgatggcggcatcccgcccatgagtag

SEQ ID NO: 2402 - DNA, 71 bp, Homo sapiens
acccatgtaccgtcctcggccagccaacccagatgaaatcggcaactttataattgagaacctgaaggcgg

SEQ ID NO: 2403 - DNA, 78 bp, Homo sapiens
aatgctgcactacgaccctaacaagcggatttcggccaaggcagccctggctcaccctttcttccaggatgtgaccaa

SEQ ID NO: 2404 - DNA, 66 bp, Homo sapiens
agcaacaccagcctcctggccacctcctctccaatgcctgtgaaagaggagtttctgccatagccc

SEQ ID NO: 2405 - DNA, 67 bp, Homo sapiens
gggcaggcaaggtttacactgcggaagccaaaggcagctaagatagaaagctggactgaccaaagac

SEQ ID NO: 2406 - DNA, 71 bp, Homo sapiens
acttgcctgttcagagcactcattccttcccacccccagtcctgtcctatcactctaattcggatttgcca

SEQ ID NO: 2407 - DNA, 72 bp, Homo sapiens
cacagcctcacttctaaccttctggaacccacccaccactgccaagctcactattgaatccacgccattcaa

SEQ ID NO: 2408 - DNA, 65 bp, Homo sapiens
gcaacccacgtgtaactgtcagccgggccctgagtaatcgcttaaagatgttcctacgggcttgt

SEQ ID NO: 2409 - DNA, 77 bp, Homo sapiens
tgacaatcagcacacctgcattcaccgctcggaagagggcctgagctgcatgaataaggatcacggctgtagtcaca

SEQ ID NO: 2410 - DNA, 63 bp, Homo sapiens
taaattcactcgtggtgtggacttcaattggcaagcccaggccctattggccctacaagaggc

SEQ ID NO: 2411 - DNA, 83 bp, Homo sapiens
ggatgctggtgacctcttcttccctcacgttgcaacaggaattaaaggctaaaagaaaacgaagagttacttggtgccttggc

SEQ ID NO: 2412 - DNA, 68 bp, Homo sapiens
ctcccgtcaacagcgttctttccaaacactggaccaggagtgcatccagatgaaggccagactcaccc

SEQ ID NO: 2413 - DNA, 77 bp, Homo sapiens
actttgcgagaaatgggaaccccaatggcgagggtctgccacactggccgctgttcgaccaggaggagcaatacctg

SEQ ID NO: 2414 - DNA, 76 bp, Homo sapiens
ctgaaggagctccaagacctcgctctccaaggcgccaaggagagggcacatcagcagaagaaacacagcggttttg

SEQ ID NO: 2415 - DNA, 80 bp, Homo sapiens
ccaccataggcagaggcaggccttcctacaccctactccctgtgcctccagcctcgactagtccctagcactcgacgact

SEQ ID NO: 2416 - DNA, 72 bp, Homo sapiens
gaggccagtggtggaaacaggtgtggagctgatgagtctgccctaccgcctggtgtttgctgtggcctcgga

SEQ ID NO: 2417 - DNA, 71 bp, Homo sapiens
ctctgtgcgaggctgtcagccacactaggtatcagggatcccgagatgggtaccagcccacagtccttacc

SEQ ID NO: 2418 - DNA, 76 bp, Homo sapiens
aaggaagtggtccctctgtggcaagtgatgaagtctccagctttgcctcagctctcccagacagaaagactgcgtc

SEQ ID NO: 2419 - DNA, 82 bp, Homo sapiens
gataaattggtacaagggatcagcttttcccagcccacatgtcctgatcatatgcttttgaatagtcagttacttggcaccc

SEQ ID NO: 2420 - DNA, 78 bp, Homo sapiens
atgtggaacccccacctacttggcgcctgaagttcttgtttctgttgggactgctgggtataaccgtgctgtggactg

SEQ ID NO: 2421 - DNA, 72 bp, Homo sapiens
tgcctgtggtgggaagctcagtaactgggaaccaaaggatgatgctatgtcagaacaccggaggcattttcc

SEQ ID NO: 2422 - DNA, 86 bp, Homo sapiens
ggatatttccgtggctcttattcaaactctccatcaaatcctgtaaactccagagcaaatcaagatttttctgccttgatgagaag

SEQ ID NO: 2423 - DNA, 78 bp, Homo sapiens
ggtccctaaaacccatctgatgtctgaatctgaatggaggaatcttggcgttcagcagagtcagggatgggtccatta

SEQ ID NO: 2424 - DNA, 62 bp, Homo sapiens
ggctggacgtggttttgtctgctgcgcccgctcttcgcgctctcgtttcattttctgcagcg

SEQ ID NO: 2425 - DNA, 72 bp, Homo sapiens
ggctgctttgctgcaactgtccaccccgcacagacaagccttactccgccaagtattctgctgcccgctctg

SEQ ID NO: 2426 - DNA, 73 bp, Homo sapiens
tctgggaggtgccctactttgctgttcctgtccccgaaaaacaacctcttacccaacaccaaggccctatcca

SEQ ID NO: 2427 - DNA, 74 bp, Homo sapiens
ggtctgccctagtcatcctgggaggtgcactgctctcctgttcctgtcctgggaatgagagcaaggctgggtac

SEQ ID NO: 2428 - DNA, 68 bp, Homo sapiens
cggtacttgagcaatgcctacgcccgggaagaattcgcttccacctgtccagatgatgaggagatcga

SEQ ID NO: 2429 - DNA, 67 bp, Homo sapiens
accgtatggacagccacagcctggctttgggtacagcatgtgagatgaagcgctgatcctgtagtca

SEQ ID NO: 2430 - DNA, 76 bp, Homo sapiens
ccccaggatacctaccactacctgcccttcagcctgccccaccggaggcctcacttcttctttcccaagtcccgca

SEQ ID NO: 2431 - DNA, 86 bp, Homo sapiens
gacatttccagtcctgcagtcaatgcctctctgccccaccctttgttcagtgtggctggtgccacgacaaatgtgtgcgatcggag

SEQ ID NO: 2432 - DNA, 84 bp, Homo sapiens
tccctccactcggaaggactatcctgctgccaagagggtcaagttggacagtgtcagagtcctgagacagatcagcaacaaccg

SEQ ID NO: 2433 - DNA, 64 bp, Homo sapiens
tccaccctcctggctttggccagcatggcgaagacgaaaggaaacaaggtgaacgtgggagtga

SEQ ID NO: 2434 - DNA, 68 bp, Homo sapiens
gtggccatccagctgaccttcctgcgcctgatgtccaccgaggcctcccagaacatcacctaccactg

SEQ ID NO: 2435 - DNA, 80 bp, Homo sapiens
cagccaagaactggtataggagctccaaggacaagaaacacgtctggctaggagaaactatcaatgctggcagccagttt

SEQ ID NO: 2436 - DNA, 72 bp, Homo sapiens
atgcccagtgttcctgacttcgaaacgctattctcacaggttcagctcttcatcagcacttgtaatggggag

SEQ ID NO: 2437 - DNA, 79 bp, Homo sapiens
tctgcagagttggaagcactctatggtgacatcgatgctgtggagctgtatcctgcccttctggtagaaaagcctcggc

SEQ ID NO: 2438 - DNA, 80 bp, Homo sapiens
tcgagtctcccttcaccatttccgacggcatctacggctcaacattttttgtagccacaggcttccacggacttcacgtc

SEQ ID NO: 2439 - DNA, 73 bp, Homo sapiens
cgtgagtacacagatgcctccttcacaaatcgaaaggagagaggccctgaagaagagcatcttggcatcctgg

SEQ ID NO: 2440 - DNA, 70 bp, Homo sapiens
tggtctgcaagcaagtattcaagaaggtgcagtgaggcccaagcagacaaccttgtcccaaccaatcagc

SEQ ID NO: 2441 - DNA, 82 bp, Homo sapiens
tgggaagcagctgtgtaccattcctcgcgatgctgcctactacagctatcagaataggtatcatttctgtgagaagtgtttc

SEQ ID NO: 2442 - DNA, 76 bp, Homo sapiens
gtgctacgccaccctgttcggacccaaaggcgtgaacatcgggggcgcgggctcctacatctacgagaagcccctg

SEQ ID NO: 2443 - DNA, 65 bp, Homo sapiens
gggtctgtgccccatgacacctggctgcccaagaagtgttccctgtgtaaatgctggcacggtca

SEQ ID NO: 2444 - DNA, 75 bp, Homo sapiens
ctccctaacctccagaatgggcccatatatgccagggttatccagaagcgagtccccaatgcctacgacaagaca

SEQ ID NO: 2445 - DNA, 72 bp, Homo sapiens
aaggtttttggattgcaaggggtttccaggggcatgtatgacggtcctgtgtacgaggtaccagctacaccc

SEQ ID NO: 2446 - DNA, 69 bp, Homo sapiens
gatgtgattgaggtgcatggaaaacatgaagagcgccaggatgaacatggtttcatctccagggagttc

SEQ ID NO: 2447 - DNA, 72 bp, Homo sapiens
ttacgcagctcatgctcttgaacggctctttactatgcgagggcctaacaatgccactctctttacagctgc

SEQ ID NO: 2448 - DNA, 74 bp, Homo sapiens
tgcagcggctgattgacagtcagatggagacctcgtgccaaattacatttgagtttgtagaccaggaacagttg

SEQ ID NO: 2449 - DNA, 64 bp, Homo sapiens
cctgaacatgaaggagctgaagctgctgcagaccatcgggaagggggagttcggagacgtgatg

SEQ ID NO: 2450 - DNA, 72 bp, Homo sapiens
gctctccatcagctcctgtctccagcagctttccctgttgatgtggatcacgcagtgctttctgcccgtgtt

SEQ ID NO: 2451 - DNA, 76 bp, Homo sapiens
gagttcaagtgccctgacggcgaggtcatgaagaagaacatgatgttcatcaagacctgtgcctgccattacaact

SEQ ID NO: 2452 - DNA, 67 bp, Homo sapiens
gctcacttcggctaaaatgcagaaatgcatgctgtcagcgttggtatttcacattcaatggagctga

SEQ ID NO: 2453 - DNA, 70 bp, Homo sapiens
cactgaggtccgggtgacagtgcttcggcaggctgacagccaggtgactgaagtctgtgcggcaacctac

SEQ ID NO: 2454 - DNA, 67 bp, Homo sapiens
gttttccaggtcggagacggaagaccggaggcagtagctgcaaagcccttggaacaccctggatgct

SEQ ID NO: 2455 - DNA, 62 bp, Homo sapiens
ggccgagatctacaaaaacggccccgtggagggagctttctctgtgtattcggacttcctgc

SEQ ID NO: 2456 - DNA, 80 bp, Homo sapiens
gtacatgatcccctgtgagaaggtgtccaccctgcccgcgatcacactgaagctgggaggcaaaggctacaagctgtccc

SEQ ID NO: 2457 - DNA, 77 bp, Homo sapiens
gcaagttccaacctggaaaggccatcggctttgtcaaggatgtagccaacatcacaatctatgacgaggaagcgatg

SEQ ID NO: 2458 - DNA, 74 bp, Homo sapiens
gggaggcttatctcactgagtgagcagaatctggtagactgctctgggcctcaaggcaatgaaggctgcaatgg

SEQ ID NO: 2459 - DNA, 67 bp, Homo sapiens
tgtctcactgagcgagcagaatctggtggactgttcgcgtcctcaaggcaatcagggctgcaatggt

SEQ ID NO: 2460 - DNA, 71 bp, Homo sapiens
atgccctggtaatgtctgcattcaacaatgacgctggctttgtggctgctcttgataaggcttgtggtcgc

SEQ ID NO: 2461 - DNA, 75 bp, Homo sapiens
aagcatcttcctgttcttggaccgcacctatgtgctgcagaactccacgctgccctccatctgggatatgggatt

SEQ ID NO: 2462 - DNA, 67 bp, Homo sapiens
gagctacagatgcccatgccgattcttcgaaagccatgttgccagagccaacgtcaagcatctcaaa

SEQ ID NO: 2463 - DNA, 72 bp, Homo sapiens
tgaccgcttctaccccaatgacttgtgggtggttgtgttccagtttcagcacatcatggttggccttatcct

SEQ ID NO: 2464 - DNA, 77 bp, Homo sapiens
ggtgcctactccattgtggcgggcgtgtttgtgtgcctgctggagtacccccgggggaagaggaagaagggctccac

SEQ ID NO: 2465 - DNA, 71 bp, Homo sapiens
ccagctttgtgcctgtcactattcctcatgccaccactgccaacacctctgtcttgggctaccacattccc

SEQ ID NO: 2466 - DNA, 73 bp, Homo sapiens
ccgtgttcaagaggaagctcactgccttgtggaggagttgagaaaaaccaaggcttcaccctgtgatcccact

SEQ ID NO: 2467 - DNA, 79 bp, Homo sapiens
agaacaaggacaacatagatccttacatatacacaccctttggaagtggacccagaaactgcattggcatgaggtttgc

SEQ ID NO: 2468 - DNA, 76 bp, Homo sapiens
tgctcattcttgaggagcattaaggtatttcgaaactgccaagggtgctggtgcggatggacactaatgcagccac

SEQ ID NO: 2469 - DNA, 77 bp, Homo sapiens
cgctgacatcatgaatgttcctcgaccggctggaggcgagtttggatatgacaaagacacatcgttgctgaaagaga

SEQ ID NO: 2470 - DNA, 75 bp, Homo sapiens
aaatgtcctcctcgactgctccgcggagtccgaccgaggagttccagtgatcaagtggaagaaagatggcattca

SEQ ID NO: 2471 - DNA, 66 bp, Homo sapiens
ggtcaccgttggtgtcatcacagtgctggtagtggtcatcgtggctgtgatttgcacccgacgctc

SEQ ID NO: 2472 - DNA, 74 bp, Homo sapiens
atggagatgtggtcattcctagtgattattttcagatagtgggaggaagcaacttacggatacttggggtggtg

SEQ ID NO: 2473 - DNA, 110 bp, Homo sapiens
gccgccacaagactaaggaatggccaccccgcccaagagaagctgcccgtctttctcagccagctctgaggggacccgcatcaagaaaatctccatcgaagggaacatcg

SEQ ID NO: 2474 - DNA, 68 bp, Homo sapiens
tgcggatcatccggaatggaattggaatccacgagcatgccagcattgacttaccaggcatcaaagga

SEQ ID NO: 2475 - DNA, 70 bp, Homo sapiens
cttgtggagatcacccaatcaggttctatgcccgggactcgggcctgctcaagtttgagatccaggcggg

SEQ ID NO: 2476 - DNA, 73 bp, Homo sapiens
ttgctataactaagtgcttctccaagaccccaactgagtccccagcacctgctacagtgagctgccattccac

SEQ ID NO: 2477 - DNA, 78 bp, Homo sapiens
gggagaacgggatcaataggatcggaaacctgctggtgcccaatgagaattactgcaagtttgaggactggctgatgc

SEQ ID NO: 2478 - DNA, 73 bp, Homo sapiens
cacaatggcggctctgaagagttggctgtcgcgcagcgtaacttcattcttcaggtacagacagtgtttgtgt

SEQ ID NO: 2479 - DNA, 62 bp, Homo sapiens
caagcagtcaaggagaaccagaagcggcgggagacagaagaaaagatgaggcgagcaaaact

SEQ ID NO: 2480 - DNA, 68 bp, Homo sapiens
tccaattccagcatcactgtggagaaaagctgtttgtctccccagcatactttatcgccttcactgcc

SEQ ID NO: 2481 - DNA, 70 bp, Homo sapiens
tgacaactaccagccgtacccgtgcgcagaggacgaggagtgcggcactgatgagtactgcgctagtccc

SEQ ID NO: 2482 - DNA, 68 bp, Homo sapiens
gattcagacgaggatgagccttgtgccatcagtggcaaatggactttccaaagggacagcaagaggtg

SEQ ID NO: 2483 - DNA, 87 bp, Homo sapiens
aggacgcaaggagggtttgtcactggcagactcgagactgtaggcactgccatggcccctgtgctcagtaaggactcggcggacatc

SEQ ID NO: 2484 - DNA, 83 bp, Homo sapiens
tgcacagagggtgtgggttacaccaatgcttccaacaatttgtttgcttgcctcccatgtacagcttgtaaatcagatgaaga

SEQ ID NO: 2485 - DNA, 84 bp, Homo sapiens
ctctgagacagtgcttcgatgactttgcagacttggtgccctttgactcctgggagccgctcatgaggaagttgggcctcatgg

SEQ ID NO: 2486 - DNA, 67 bp, Homo sapiens
cctggatctcccaggtatcattgaaggtgccaaggatgggaaaggtagaggtcgtcaagtcattgca

SEQ ID NO: 2487 - DNA, 73 bp, Homo sapiens
tggcactactgcatgattgacatagagaagatcagggccatgacaatcgccaagctgaaaacaatgcggcagg

SEQ ID NO: 2488 - DNA, 78 bp, Homo sapiens
aaatcgctgggaacaagtgccgttaattaaggaaaagttgagccagggcgtgaccctcgtcgtggacagatacgcatt

SEQ ID NO: 2489 - DNA, 76 bp, Homo sapiens
agacatcagctcctggttcaacgaggccattgacttcatagactccatcaagaatgctggaggaagggtgtttgtc

SEQ ID NO: 2490 - DNA, 76 bp, Homo sapiens
tatccctgtggaggacaaccagatggtggagatcagtgcctggttccaggaggccataggcttcattgactgggtg

SEQ ID NO: 2491 - DNA, 67 bp, Homo sapiens
acacatggagtgcttctggaactatcagcccacttgaccacccagtttgtggaagcacaggcaagag

SEQ ID NO: 2492 - DNA, 79 bp, Homo sapiens
agcatgacacggagatgaagtactatatagtacacctgaagcggcacttcatgttccggaaccacctgtgcctggtatt

SEQ ID NO: 2493 - DNA, 75 bp, Homo sapiens
actccctctacccttgagcaagggcaggggtccctgagctgttcttctgccccatactgaaggaactgaggcctg

SEQ ID NO: 2494 - DNA, 73 bp, Homo sapiens
tgccacctggacatcatttgggtcaacactcccgagcacgttgttccgtatggacttggaagccctaggtcca

SEQ ID NO: 2495 - DNA, 68 bp, Homo sapiens
tacatctccaaacccatccaccagcatgaagaccgctgcttgaggttgaaggtgactgtcagtggcaa

SEQ ID NO: 2496 - DNA, 67 bp, Homo sapiens
actacatctccacgcccactcacaacctgcactggaagtgtctgaggatgaaggtgttcgtctgctg

SEQ ID NO: 2497 - DNA, 66 bp, Homo sapiens
ggagcccgtatcctggagctccctcaaccccaagttcctgagtgggaagggcttggtgatctatcc

SEQ ID NO: 2498 - DNA, 73 bp, Homo sapiens
tgacattatcatcccgctaaggactgcggacagcgtcttctgccctcactacgagaaggtcagcggggactac

SEQ ID NO: 2499 - DNA, 74 bp, Homo sapiens
ttgaacagagcctgaccaagagggatgagttcgagtttctggagaaagcatcaaaactgcgaggaatctcaaca

SEQ ID NO: 2500 - DNA, 62 bp, Homo sapiens
tgtcgatggacttccagaaccacctgggcagctgccaaaagtgtgatccaagctgtcccaat

SEQ ID NO: 2501 - DNA, 79 bp, Homo sapiens
tcaatggccggacgaaagccatggttgcttgttatccgggcaatggaacgggttatgtacgtcatgttgataatccaaa

SEQ ID NO: 2502 - DNA, 68 bp, Homo sapiens
gctggtcctctactgcgggagccggctgggcaaatactacgtcaaggagaggtctaaggcaatggtgg

SEQ ID NO: 2503 - DNA, 76 bp, Homo sapiens
gtccccgctgcagatctctgacccgttcggatcctttcctcactcgcccaccatggacaactaccctaagctggag

SEQ ID NO: 2504 - DNA, 78 bp, Homo sapiens
ccatgtggatgaatgaggtgtctcctttccatacccagtctcaccttctccccaccctacctcacctcttctcaggca

SEQ ID NO: 2505 - DNA, 72 bp, Homo sapiens
aaagtggtgaatgccatttggtttcaggatatagctgacctggcatttgaggtatcagggaggaagcctcac

SEQ ID NO: 2506 - DNA, 82 bp, Homo sapiens
gatctaagatggcgactgtcgaaccggaaaccacccctactcctaatcccccgactacagaagaggagaaaacggaatctaa

SEQ ID NO: 2507 - DNA, 67 bp, Homo sapiens
aagccgcggttgaatgtgccatgaccctctccctctctggatggcaccatcattgaagctggcgtca

SEQ ID NO: 2508 - DNA, 77 bp, Homo sapiens
gacaggaggcctctatcctgtccctccaccccaccctccacctcaatcccctcccatcttccccagacctacctcac

SEQ ID NO: 2509 - DNA, 75 bp, Homo sapiens
gctagtactttgatgctcccttgatggggtccagagagcctccctgcagccaccagacttggcctccagctgttc

SEQ ID NO: 2510 - DNA, 69 bp, Homo sapiens
tggcctacctcttcaccatcatcaacagcctccaaggcttcttcatcttcttggtctactgcctcctca

SEQ ID NO: 2511 - DNA, 68 bp, Homo sapiens
ggcagtgtcactgagtccttgaaatcctcccctgccccgcgggtctctggattgggacgcacagtgca

SEQ ID NO: 2512 - DNA, 68 bp, Homo sapiens
caaggccgtgaacgagaagtcctgcaactgcctcctgctcaaagtcaaccagattggctccgtgaccg

SEQ ID NO: 2513 - DNA, 75 bp, Homo sapiens
agccccagcaactacagtctgggatgccaaggccagccatgatgtcagtggcccagcatggtcaacctttgaaca

SEQ ID NO: 2514 - DNA, 72 bp, Homo sapiens
aagccttggagggtttcattgccgtggtgacccaagatggcgacatgatctttctgtcagaaaacatcagca

SEQ ID NO: 2515 - DNA, 75 bp, Homo sapiens
gggccctccagaacaatgatgggctttatgatcctgactgcgatgagagcgggctctttaaggccaagcagtgca

SEQ ID NO: 2516 - DNA, 72 bp, Homo sapiens
cgcctgttcaccaagattgacaccattgcgcccgatgagatcaccgtcagcagcgacttcgaggcacgccac

SEQ ID NO: 2517 - DNA, 66 bp, Homo sapiens
caaccaggcagctccatcggcagtgtccatcatgcatcaggtgagccgcaccgtggacagcattac

SEQ ID NO: 2518 - DNA, 77 bp, Homo sapiens
tgaacggggtatcctccttagccacggggcccgtcccatttgagcctgtcaatgtcaccactgaccgagaggtacct

SEQ ID NO: 2519 - DNA, 69 bp, Homo sapiens
actggtcctccatcggctccccaggagctttggtttgaggtgcaaggctcagcactcatgctacactgg

SEQ ID NO: 2520 - DNA, 67 bp, Homo sapiens
actgtggcacttaggggagatgacatttgctttgggcagaggcagctagccaggacacatttccact

SEQ ID NO: 2521 - DNA, 81 bp, Homo sapiens
cggttatgtcatgccagatacacacctcaaaggtactccctcctcccgggaaggcaccctttcttcagtgggtctcagttc

SEQ ID NO: 2522 - DNA, 67 bp, Homo sapiens
gtccaggtggatgtgaaagatccccagcaggccctcaaggagctggctaagatgtgtatcctggccg

SEQ ID NO: 2523 - DNA, 69 bp, Homo sapiens
tggccttcttcaccagctaccagtacatggagagcaccgtggcctcctggtatgagcaggggatccttg

SEQ ID NO: 2524 - DNA, 91 bp, Homo sapiens
ataacaaagtgtagctctgacatgaatggctattgtttgcatggacagtgcatctatctggtggacatgagtcaaaactactgcaggtgtg

SEQ ID NO: 2525 - DNA, 67 bp, Homo sapiens
acggatcacagtggaggaagcgctggctcacccctacctggagcagtactatgacccgacggatgag

SEQ ID NO: 2526 - DNA, 68 bp, Homo sapiens
agttcttgacccctggtcctgtctccagcccgtcttggcttatccactttgactcctttgagccgttt

SEQ ID NO: 2527 - DNA, 70 bp, Homo sapiens
acccccagaccggatcaggcaagctggccctcatgtccccttcacggtgtttgaggaagtctgccctaca

SEQ ID NO: 2528 - DNA, 68 bp, Homo sapiens
cgtggtgcccctctatgacctgctgctggagatgctggacgcccaccgcctacatgcgcccactagcc

SEQ ID NO: 2529 - DNA, 67 bp, Homo sapiens
tccagtgcctatgacccccccagacaaatcgccatcaagtcccctgcccctggtgcccttggacagt

SEQ ID NO: 2530 - DNA, 73 bp, Homo sapiens
gtgaaggatgtgaagcagacgtacttggcacgggtcttctcctacccggcagggaatgtggagagcaccggtt

SEQ ID NO: 2531 - DNA, 66 bp, Homo sapiens
gctttgccaccaggaaagtggctggcatggccaaacctaacatgatcatcagtgtgaatggggatg

SEQ ID NO: 2532 - DNA, 66 bp, Homo sapiens
ctgaccagaaccacggcttatccggcctgtccacgaaccacttatacacccacatgacccacttcc

SEQ ID NO: 2533 - DNA, 91 bp, Homo sapiens
ggattgctcaacaaccatgctgggcatctggaccctcctacctctggttcttacgtctgttgctagattatcgtccaaaagtgttaatgcc

SEQ ID NO: 2534 - DNA, 80 bp, Homo sapiens
gcactttgggattctttccattatgattctttgttacaggcaccgagaatgttgtattcagtgagggtcttcttacatgc

SEQ ID NO: 2535 - DNA, 66 bp, Homo sapiens
gcctcttcctgttcgacggctcgcccacctacgtactggcctacacccagagctaccgggcaaagc

SEQ ID NO: 2536 - DNA, 90 bp, Homo sapiens
ggctattcctcattttctctacaaagtggcctcagtgaacatgaagaaggtagcctcctggaggagaatttcggtgacagtctacaatcc

SEQ ID NO: 2537 - DNA, 73 bp, Homo sapiens
ccccagtttcaacgagacttcatttcattgctccctaaagagttggcactctatgtgctttcattcctggaac

SEQ ID NO: 2538 - DNA, 71 bp, Homo sapiens
gagatgattcagttaccgggagcccggcccattttggatcctgtggatttcttgggtctccaggacaagat

SEQ ID NO: 2539 - DNA, 68 bp, Homo sapiens
ctctgcaggcctaggtgcagctcctcagcggctccagctcatatgctgacagctcttcacagtcctgg

SEQ ID NO: 2540 - DNA, 68 bp, Homo sapiens
cggtagtcaagtccggatcaagggcaaggagacggaattctacctgtgcatgaaccgcaaaggcaagc

SEQ ID NO: 2541 - DNA, 76 bp, Homo sapiens
agatgcaggagagaggaagccttgcaaacctgcagactgctttttgcccaatatagattgggtaaggctgcaaaac

SEQ ID NO: 2542 - DNA, 74 bp, Homo sapiens
cacgggacattcaccacatcgactactataaaaagacaaccaacggccgactgcctgtgaagtggatggcaccc

SEQ ID NO: 2543 - DNA, 80 bp, Homo sapiens
gagggactgttggcatgcagtgccctcccagagaccaacgttcaagcagttggtagaagacttggatcgaattctcactc

SEQ ID NO: 2544 - DNA, 67 bp, Homo sapiens
ccagtggagcgcttccatgacctgcgtcctgatgaagtggccgatttgtttcagacgacccagagag

SEQ ID NO: 2545 - DNA, 72 bp, Homo sapiens
ggttccagctttctgtagctgtaagcattggtggccacaccacctccttacaaagcaactagaacctgcggc

SEQ ID NO: 2546 - DNA, 66 bp, Homo sapiens
ccaccagcatgaagtttcggacagacatggcctttgtgaggggttccagttgtgcttcagacagcc

SEQ ID NO: 2547 - DNA, 73 bp, Homo sapiens
gccacacaaacatgctcctgctcctggcggaggcagagctgctgggaaagacatttcggaagtttcctgtggc

SEQ ID NO: 2548 - DNA, 75 bp, Homo sapiens
ggctcccgaatctatctttgacaaaatctacagcaccaagagcgacgtgtggtcttacggagtattgctgtggga

SEQ ID NO: 2549 - DNA, 69 bp, Homo sapiens
accaagaagctgaggacctgtggctgagcccgctgaccatggaagatcttgtctgctacagcttccagg

SEQ ID NO: 2550 - DNA, 67 bp, Homo sapiens
cgagccctttgatgacttcctgttcccagcatcatccaggcccagtggctctgagacagcccgctcc

SEQ ID NO: 2551 - DNA, 83 bp, Homo sapiens
tgaagtccaggacgatgatgcgcctctctcgcccatgctctacagcagctcagccagcctgtcaccttcagtaagcaagccgt

SEQ ID NO: 2552 - DNA, 66 bp, Homo sapiens
cagccctgccagtttgactatgccgtcttctgccctaacctgacagaggtgtcatccacaggcaac

SEQ ID NO: 2553 - DNA, 75 bp, Homo sapiens
ttggtacctgtgggttagcatcaagttctccccagggtagaattcaatcagagctccagtttgcatttggatgtg

SEQ ID NO: 2554 - DNA, 72 bp, Homo sapiens
gtaagtcggatgagcctgtctgtgccagtgacaatgccacttatgccagcgagtgtgccatgaaggaagctg

SEQ ID NO: 2555 - DNA, 95 bp, Homo sapiens
aagtcctcgatacgcactatagcaccgagaatgacgtggagaccatccgggccagcgtctgcgccccctgccacgcctcatgtgccacatgccag

SEQ ID NO: 2556 - DNA, 80 bp, Homo sapiens
ggataattcagacaacaacaccatctttgtgcaaggcctgggtgagaatgttacaattgagtctgtggctgattacttca

SEQ ID NO: 2557 - DNA, 66 bp, Homo sapiens
ccgtgctcattgctaaccactgtctgtccctgaactcccagaaccactacatctggctttgggcag

SEQ ID NO: 2558 - DNA, 73 bp, Homo sapiens
cagttcggtccaacagagaaagcaggcaaccaccatgtcatttgaaaacagtttcatcgggatataattcgca

SEQ ID NO: 2559 - DNA, 66 bp, Homo sapiens
cgtgtgtctcaagacgatcccactgtgtaccctaatgggtcccgcttcccagacagcacagggacc

SEQ ID NO: 2560 - DNA, 67 bp, Homo sapiens
agagcaccaaagcagctcatcccactgatgacaccacgacgctctctgagagaccatccccaagcac

SEQ ID NO: 2561 - DNA, 69 bp, Homo sapiens
gaagcgcagatcatgaagaagctgaagcacgacaagctggtccagctctatgcagtggtgtctgaggag

SEQ ID NO: 2562 - DNA, 75 bp, Homo sapiens
ggtgcaccagttctaccctctagtgaaagtgcagtgttccgctgagctcaagttcttcctgtgctccatgtacgc

SEQ ID NO: 2563 - DNA, 78 bp, Homo sapiens
tggatcctcacctggtcggtgctgtgctgcgcttccaccttcttcactgtcaccacgtacttggtagacatgcagcgc

SEQ ID NO: 2564 - DNA, 67 bp, Homo sapiens
aatgagagaggtgaaagcggacggagctagcacccccaggttaagagaacaggactgtggtgaacct

SEQ ID NO: 2565 - DNA, 68 bp, Homo sapiens
tcagcagcaagggcatcatggaggaggatgaggcctgcgggcgccagtacacgctcaagaaaaccacc

SEQ ID NO: 2566 - DNA, 61 bp, Homo sapiens
caacgaattccaggtgtccctgagcagctccatgtcggtgtcagagctgaaggcgcagatc

SEQ ID NO: 2567 - DNA, 73 bp, Homo sapiens
gtgctggtgacgaatccacattcatctcaatggaaggatcctgccttaagtcaacttatttgtttttgccggg

SEQ ID NO: 2568 - DNA, 70 bp, Homo sapiens
accctcgacaagaccacactttgggacttgggagctggggctgaagttgctctgtacccatgaactccca

SEQ ID NO: 2569 - DNA, 66 bp, Homo sapiens
cgcgctgcagatccattttacgctgatccaggctttctgctgcgagaacgacatcgacatagtgcg

SEQ ID NO: 2570 - DNA, 74 bp, Homo sapiens
ggaacagggtcacccacagactgggtgtgagtgtgaagatggtcctgatgggcaggagatggacccgccaaatc

SEQ ID NO: 2571 - DNA, 73 bp, Homo sapiens
ttgggaaatatttgggcattggtctggccaagtctacaatgtcccaatatcaaggacaaccaccctagcttct

SEQ ID NO: 2572 - DNA, 83 bp, Homo sapiens
gcatgggaaccatcaaccagcaggccatggaccaacttcactatgtgacagagctgacagatcgaatcaaggcaaactcctca

SEQ ID NO: 2573 - DNA, 71 bp, Homo sapiens
ctgttgcaggaaggcattgatcatctcctggcccagcatgttgctcatctctttattagagacccactgac

SEQ ID NO: 2574 - DNA, 85 bp, Homo sapiens
tgtagaatcaaactcttcatcatcaactagaagtgcagttgacatggcctgttcagtccttggagttgcacagctggattctgtg

SEQ ID NO: 2575 - DNA, 75 bp, Homo sapiens
tggtgcttggagcatagaagactgcccttcacaaaggaaatccctgattattgtttgaaatgctgaggacgttgc

SEQ ID NO: 2576 - DNA, 72 bp, Homo sapiens
cgctccagacctatgatgacttgttagccaaagactgccactgcatatgagcagtcctggtccttccactgt

SEQ ID NO: 2577 - DNA, 71 bp, Homo sapiens
gtgtatgacgaggtggatcgaagagaaaatgatgcagtgtggctggctacccaaaaccacagcactctggt

SEQ ID NO: 2578 - DNA, 68 bp, Homo sapiens
gttcactgggggtgtatggggtagatgggtggagagggaggggataagagaggtgcatgttggtattt

SEQ ID NO: 2579 - DNA, 74 bp, Homo sapiens
tgtcatgtacgacggcttctccatgcagcggctggtgaagtgcaacgcctggccttgtcccaacactgtggact

SEQ ID NO: 2580 - DNA, 67 bp, Homo sapiens
gcttatgaccgaccccaagctcatcacctggtctccggtgtgtcgcaacgatgttgcctggaacttt

SEQ ID NO: 2581 - DNA, 75 bp, Homo sapiens
cacacagatctcctactccatccagtcctgaggagccttaggatgcagcatgccttcaggagacactgctggacc

SEQ ID NO: 2582 - DNA, 67 bp, Homo sapiens
cttcgcctttgctgattgcctctccaaacgcctgcctgacgactgccttggagcatgtgcgttatgg

SEQ ID NO: 2583 - DNA, 76 bp, Homo sapiens
tcccactgaagccctttcagttgcggttgaagaaggactcgcttggaggaaaaaaggatgtttacgcctgggcact

SEQ ID NO: 2584 - DNA, 79 bp, Homo sapiens
gtccatcagtgcatgacgtttaaggccacgtatagtcctagctgacgccaataataaaaaacaagaaaccaagtgggct

SEQ ID NO: 2585 - DNA, 67 bp, Homo sapiens
ccatctgcatccatcttgtttgggctccccacccttgagaagtgcctcagataataccctggtggcc

SEQ ID NO: 2586 - DNA, 75 bp, Homo sapiens
gttgggtgcatctctcgggcgtccggcagcggctgtatctcggcatgaattaagaagctaggaagatggagcacg

SEQ ID NO: 2587 - DNA, 73 bp, Homo sapiens
cgaaaagatgctgaacagtgacaaatccaactgaccagaagggaggaggaagctcactggtggctgttcctga

SEQ ID NO: 2588 - DNA, 81 bp, Homo sapiens
ctgggtctcatagaagcaaaggagaacagaaaccaccagccacctcaacccaaggccttgggcaatcagcagccttcgtgg

SEQ ID NO: 2589 - DNA, 73 bp, Homo sapiens
atgctgctggccattccagaggccgtgttttctgacctccatcccttccatgaggaaagcaccaaccagacct

SEQ ID NO: 2590 - DNA, 66 bp, Homo sapiens
gacaaggacggcagcaaggtgacaacagtggtggcaactcctgggcagggtccagacaggccacaa

SEQ ID NO: 2591 - DNA, 66 bp, Homo sapiens
tctccaacttccctctgctgaaggccctgaaaaccagaatcagcaacctgcccacggtgaagaagt

SEQ ID NO: 2592 - DNA, 86 bp, Homo sapiens
aagctatgaggaaaagaagtacacgatgggggacgctcctgattatgacagaagccagtggctgaatgaaaaattcaagctgggcc

SEQ ID NO: 2593 - DNA, 76 bp, Homo sapiens
caatgccatcttgcgctacatcgctcgcaagcacaacatgtgtggtgagactgaagaagaaaagattcgagtggac

SEQ ID NO: 2594 - DNA, 76 bp, Homo sapiens
gagaccctgctgtcccagaaccagggaggcaagaccttcattgtgggagaccagatctccttcgctgactacaacc

SEQ ID NO: 2595 - DNA, 66 bp, Homo sapiens
caccatccccaccctgtcttccacagccgcctgaaagccacaatgagaatgatgcacactgaggcc

SEQ ID NO: 2596 - DNA, 71 bp, Homo sapiens
ccggaaaggccaagacaaaggcggtttcccgctcgcagagagccggcttgcagttcccagtgggccgtatt

SEQ ID NO: 2597 - DNA, 80 bp, Homo sapiens
gactccttcgtccccagttgccgtctaggattgggcctcccataattgctttgccaaaataccagagccttcaagtgcca

SEQ ID NO: 2598 - DNA, 90 bp, Homo sapiens
tgacacccttaccttcctgagaaataccccctgggagcgcggaaagcagagcggacaggtcagtgacttctatttttgactcgtgttttt

SEQ ID NO: 2599 - DNA, 74 bp, Homo sapiens
caagtaccacagcgatgactacattaaattcttgcgctccatccgtccagataacatgtcggagtacagcaagc

SEQ ID NO: 2600 - DNA, 76 bp, Homo sapiens
ggtggctacacaatccgtaatgttgctcgatgttggacatatgagactgcagttgcccttgattgtgagattccca

SEQ ID NO: 2601 - DNA, 66 bp, Homo sapiens
tcctaggcattctggacctctgggttgggatcaggggtaggaatggaaggatggagcatcaacagc

SEQ ID NO: 2602 - DNA, 60 bp, Homo sapiens
agccgtgactgttgaggtcaagtccagcatcgcaggcagcagcacctgggaacgttactt

SEQ ID NO: 2603 - DNA, 84 bp, Homo sapiens
aggctgctggaggtcatctccgtgtgtgattgccccagaggccgtttcttggccgccatctgccaagactgtggccgcaggaag

SEQ ID NO: 2604 - DNA, 70 bp, Homo sapiens
cggtgtgagaagtgcagcaagccctgtgcccgagtgtgctatggtctgggcatggagcacttgcgagagg

SEQ ID NO: 2605 - DNA, 69 bp, Homo sapiens
caccctgtcctatccttcctcagaccctcttgggacctagtctctgccttctactctctacccctggcc

SEQ ID NO: 2606 - DNA, 67 bp, Homo sapiens
ttagggaccctgcagctctggagtgggtggagggagggagctacgggcaggaggaagaattttgtag

SEQ ID NO: 2607 - DNA, 65 bp, Homo sapiens
ccgaaatccagatgatgatgctcatggaccctggtgctacacgggaaatccactcattccttggg

SEQ ID NO: 2608 - DNA, 82 bp, Homo sapiens
tgaacataaagtctgcaacatggaaggtattgcactgcacaggccacattcacgtatatgataccaacagtaaccaacctca

SEQ ID NO: 2609 - DNA, 66 bp, Homo sapiens
tacgcacagaggcaagcagctaagagtccgggatccccagcctactgcctctccagcacttctctc

SEQ ID NO: 2610 - DNA, 73 bp, Homo sapiens
tccatgatggttctgcaggtttctgcggccccccggacagtggctctgacggcgttactgatggtgctgctca

SEQ ID NO: 2611 - DNA, 67 bp, Homo sapiens
gacgatttgccagctttgaggctcaaggtgcattggccaacatagctgtggacaaagccaacctgga

SEQ ID NO: 2612 - DNA, 66 bp, Homo sapiens
gctttctcaggacctggttgctactggttcggcaactgcagaaaatgtcctcccttgtggcttcct

SEQ ID NO: 2613 - DNA, 70 bp, Homo sapiens
cctgcgcggctactacaaccagagcgaggccagttctcacaccctccagtggatgattggctgcgacctg

SEQ ID NO: 2614 - DNA, 71 bp, Homo sapiens
tggcctgtccattggtgatgttgcgaagaaactgggagagatgtggaataacactgctgcagatgacaagc

SEQ ID NO: 2615 - DNA, 74 bp, Homo sapiens
ctacttccagcaaccccagaaagagacatcgggaagattctgatgtggaaatggtggaagatgattcccgaaag

SEQ ID NO: 2616 - DNA, 84 bp, Homo sapiens
caagggagcgaccaactgatcgcacacatgctttgtttggatatggagtgaacacaattatgtaccaaatttaacttggcaaac

SEQ ID NO: 2617 - DNA, 66 bp, Homo sapiens
gccagtaagaacgaggaggatgaaggccattcaaactcctccccacgacactctgaagcagcgacg

SEQ ID NO: 2618 - DNA, 69 bp, Homo sapiens
agtgacagatggacaatgcaagaatgaactccttcctggaataccccatacttagcagtggcgactcgg

SEQ ID NO: 2619 - DNA, 78 bp, Homo sapiens
tcccttgtgttccttctgtgaagaagccctgttctcgttgccctaattcatcttttaatcatgagcctgtttattgcc

SEQ ID NO: 2620 - DNA, 71 bp, Homo sapiens
cgtgccttatggttactttggaggcgggtactactcctgccgagtgtcccggagctcgctgaaaccctgtg

SEQ ID NO: 2621 - DNA, 68 bp, Homo sapiens
cagcctcaagttcggttttcgctaccggagccttcccagaacaaacttcttgtgcgtttgcttccaac

SEQ ID NO: 2622 - DNA, 67 bp, Homo sapiens
ggacgaatacgaccccactatagaggattcctaccggaagcaggtggtcattgatggggagacgtgc

SEQ ID NO: 2623 - DNA, 67 bp, Homo sapiens
ggagatggccgagactgaccccaagaccgtgcaggacctcacctcggtggtgcagacactcctgcag

SEQ ID NO: 2624 - DNA, 78 bp, Homo sapiens
ctggaccgcacggacatccacaccttccaccgcttctaccaatacctcgcccacagcaagcaagtctttcgcgaggcg

SEQ ID NO: 2625 - DNA, 68 bp, Homo sapiens
gctttccaagtggggaattaaagttgcttccatccaacctggaggcttcctaacaaatatcgcaggca

SEQ ID NO: 2626 - DNA, 70 bp, Homo sapiens
ctgctgcgacagtccactacctttttcgagagtgactcccgttgtcccaaggcttcccagagcgaacctg

SEQ ID NO: 2627 - DNA, 63 bp, Homo sapiens
ggtccgcttcgtctttcgagagtgactcccgcggtcccaaggctttccagagcgaacctgtgc

SEQ ID NO: 2628 - DNA, 72 bp, Homo sapiens
ttcagtgtgtccagtgcatctttagtggaggttcacaagtctgaggaaaatgaggagccaatggaaacagat

SEQ ID NO: 2629 - DNA, 84 bp, Homo sapiens
ggctagtagaactggatcccaacaccaaactcttaattagacctaggcctcagctgcactgcccgaaaagcatttgggcagacc

SEQ ID NO: 2630 - DNA, 73 bp, Homo sapiens
cctccctctggtggtgcttcctcagggcccaccattgaagaggttgattaagccaaccaagtgtagatgtagc

SEQ ID NO: 2631 - DNA, 84 bp, Homo sapiens
ccgactggaggagcataaaagcgcagccgagcccagcgccccgcacttttctgagcagacgtccagagcagagtcagccagcat

SEQ ID NO: 2632 - DNA, 71 bp, Homo sapiens
caaaaggcagaggctgataagaacgacaagtctgtgaaggatctggtcatcttgctttatgaaactgcgct

SEQ ID NO: 2633 - DNA, 78 bp, Homo sapiens
gcaagcaacagtagtcgctgttggatcgggttctaaaggaaagggtggagagattcaaccagttagcgtgaaagttgg

SEQ ID NO: 2634 - DNA, 66 bp, Homo sapiens
gagtacgtgtgccgagtgttgggcagctccgtgcctctagaggcctctgtcctggtcaccattgag

SEQ ID NO: 2635 - DNA, 68 bp, Homo sapiens
gcagacagtgaccatctacagctttccggcgcccaacgtgattctgacgaagccagaggtctcagaag

SEQ ID NO: 2636 - DNA, 62 bp, Homo sapiens
ggtcatcctgacactgcaacccactttggtggctgtgggcaagtccttcaccattgagtgca

SEQ ID NO: 2637 - DNA, 70 bp, Homo sapiens
agaaccgcaaggtgagcaaggtggagattctccagcacgtcatcgactacatcagggaccttcagttgga

SEQ ID NO: 2638 - DNA, 76 bp, Homo sapiens
aacgactgctactccaagctcaaggagctggtgcccagcatcccccagaacaagaaggtgagcaagatggaaatcc

SEQ ID NO: 2639 - DNA, 80 bp, Homo sapiens
cttcaccaaatcccttcctggagactaaacctggtgctcaggagcgaaggactgtgaacttgtagcctgaagagccagag

SEQ ID NO: 2640 - DNA, 83 bp, Homo sapiens
tggcctggctcttaatttgcttttgttttgcccagtatagactcggaagtaacagttatagctagtggtcttgcatgattgca

SEQ ID NO: 2641 - DNA, 76 bp, Homo sapiens
tgacaaccaagcaaatgtgaggagtctggtgacctggggcaactttgcctggatgtattaccacatgggcagactg

SEQ ID NO: 2642 - DNA, 76 bp, Homo sapiens
tccggagctgtgatctaaggaggctggagatgtattgcgcacccctcaagcctgccaagtcagctcgctctgtccg

SEQ ID NO: 2643 - DNA, 83 bp, Homo sapiens
gcatggtagccgaagatttcacagtcaaaatcggagattttggtatgacgcgagatatctatgagacagactattaccggaaa

SEQ ID NO: 2644 - DNA, 72 bp, Homo sapiens
ccgtgcttccggacaacttccccagataccccgtgggcaagttcttccaatatgacacctggaagcagtcca

SEQ ID NO: 2645 - DNA, 73 bp, Homo sapiens
gtggacagcaccatgaacatgttgggcgggggaggcagtgctggccggaagcccctcaagtcgggtatgaagg

SEQ ID NO: 2646 - DNA, 68 bp, Homo sapiens
acgcaccgggtgtctgatcccaagttccaccccctccattcaaagataatcatcatcaagaaagggca

SEQ ID NO: 2647 - DNA, 69 bp, Homo sapiens
tggacaagtacgggatgaagctgccaggcatggagtacgttgacggggactttcagtgccacaccttcg

SEQ ID NO: 2648 - DNA, 77 bp, Homo sapiens
tgaaccgcagagaccaacagaggaatccaggcacctctaccacgccctcccagcccaattctgcgggtgtccaagac

SEQ ID NO: 2649 - DNA, 68 bp, Homo sapiens
gggtcactatggagttcaaaggacagaactcctgcctggtgaccgggacaacctggccattcagaccc

SEQ ID NO: 2650 - DNA, 76 bp, Homo sapiens
aaggacgaggagaacacaggcgccgaccgcctcatgacccagcgctgcaaggaccgcctgaactcgctggctatct

SEQ ID NO: 2651 - DNA, 70 bp, Homo sapiens
aaggaaccatctcactgtgtgtaaacatgacttccaagctggccgtggctctcttggcagccttcctgat

SEQ ID NO: 2652 - DNA, 79 bp, Homo sapiens
ggcgctgtcatcgatttcttccctgtgaaaacaagagcaaggccgtggagcaggtgaagaatgcctttaataagctcca

SEQ ID NO: 2653 - DNA, 67 bp, Homo sapiens
agctgaggaagatgctggttccctgcccacagaccttccaggagaatgacctgagcaccttctttcc

SEQ ID NO: 2654 - DNA, 72 bp, Homo sapiens
cctgaaccttccaaagatggctgaaaaagatggatgcttccaatctggattcaatgaggagacttgcctggt

SEQ ID NO: 2655 - DNA, 74 bp, Homo sapiens
ggcctaatgttccagatccttcaaagagtcatattgcccagtggtcacctcacactcctccaaggcacaatttt

SEQ ID NO: 2656 - DNA, 63 bp, Homo sapiens
agccatcactctcagtgcagccaggtcctatcgtggcccctgaggagaccctgactctgcagt

SEQ ID NO: 2657 - DNA, 67 bp, Homo sapiens
gaaagtgtttgcggagcacaagatctcctacagcggccagttcttggtcaaatccggctacgccttc

SEQ ID NO: 2658 - DNA, 81 bp, Homo sapiens
caatctgatcccagggttgaacctcagcgcacttggcatcttttcaacaggactgtccgtgctatctccaccagcagggcc

SEQ ID NO: 2659 - DNA, 72 bp, Homo sapiens
tgtttccaagatcctgctgaaagtgaacgagcctcagataaagcaaagatggattccagccaaccagaaaga

SEQ ID NO: 2660 - DNA, 65 bp, Homo sapiens
cctacagcaagtgcaaggaatacagtgacgacaaagtgcagctggccatgcagacctacgagatg

SEQ ID NO: 2661 - DNA, 78 bp, Homo sapiens
cctcccagtttcatcttccactactgtcatggtggttgtgggctgcacatcccaccaaacctgtcccttccagtccct

SEQ ID NO: 2662 - DNA, 72 bp, Homo sapiens
gtgcccgagccatatagcaggcacgtccgggtcctcactgtccttccactcaacagtcatcaaccactaccg

SEQ ID NO: 2663 - DNA, 72 bp, Homo sapiens
agcctccaggataccagcaaatggatgcggtgacaaatggcagcttagctacaaatgcctgtcagtcggaga

SEQ ID NO: 2664 - DNA, 74 bp, Homo sapiens
ccacagctcaccttctgtcaggtgtccatcccagctccagccagctcccagagaggaagagactggcactgagg

SEQ ID NO: 2665 - DNA, 77 bp, Homo sapiens
ccatgatcctcactctgctggtggactatacactccagacctcgcttagcatggtaaatcaccggctacaaagcttc

SEQ ID NO: 2666 - DNA, 66 bp, Homo sapiens
caacgcttcagtgatcaatcccggggcgatttacagatgcaggatcggaaagaatcccggccagac

SEQ ID NO: 2667 - DNA, 75 bp, Homo sapiens
aggccagccctacattatcagagcaagagccggatagaggacaaggctcagatcttgctggactgtggagaagac

SEQ ID NO: 2668 - DNA, 69 bp, Homo sapiens
cagtgacaaacagcccttccaacccaaggaatcccacaaaagatggcgatgacgcccatgaggctaaac

SEQ ID NO: 2669 - DNA, 79 bp, Homo sapiens
gatatgattggtcgctgctttgtgctcagccaggacctggccatccgggatgagttggatggtggggaatggaagttct

SEQ ID NO: 2670 - DNA, 79 bp, Homo sapiens
actcggactgcacaagctatttttgatgacagctatttgggttattctgtggctgtcggagatttcaatggtgatggca

SEQ ID NO: 2671 - DNA, 74 bp, Homo sapiens
tcagaattggatttggctcatttgtggaaaagactgtgatgccttacattagcacaacaccagctaagctcagg

SEQ ID NO: 2672 - DNA, 78 bp, Homo sapiens
accgggagccctacatgaccgaaaatacctgcaaccgttactgccgtgacgagattgagtcagtgaaagagcttaagg

SEQ ID NO: 2673 - DNA, 66 bp, Homo sapiens
caaggtgccctcagtggagctcaccaacctgtacccgtattgcgactatgagatgaaggtgtgcgc

SEQ ID NO: 2674 - DNA, 71 bp, Homo sapiens
tcgtgaaagatgaccaggaggctgtgctatgtttctacaaaaccgccaaggactgcgtcatgatgttcacc

SEQ ID NO: 2675 - DNA, 71 bp, Homo sapiens
gtcaaaatggggagggactagggcagtttggatagctcaacaagatacaatctcactctgtggtggtcctg

SEQ ID NO: 2676 - DNA, 79 bp, Homo sapiens
gagcgcaaagtggaaatcgccttctaccggaaagatgggagctgcttcctatgtctggtggatgtggtgcccgtgaaga

SEQ ID NO: 2677 - DNA, 76 bp, Homo sapiens
tcctgctgctggtcatctacacggctgtcttcacaccctactcggctgccttcctgctgaaggagacggaagaagg

SEQ ID NO: 2678 - DNA, 69 bp, Homo sapiens
cctatcagccgctggtgtggttctggatcctgctcggcctggcttacttcgcctcagtgctcaccacca

SEQ ID NO: 2679 - DNA, 68 bp, Homo sapiens
gaggacgaaggcctctacacctgccaggcatgcagtgttcttggctgtgcaaaagtggaggcattttt

SEQ ID NO: 2680 - DNA, 80 bp, Homo sapiens
cggactttgggtgcgacttgacgagcggtggttcgacaagtggccttgcgggccggatcgtcccagtggaagagttgtaa

SEQ ID NO: 2681 - DNA, 66 bp, Homo sapiens
gtgtcctggtccatgtggtgcacgtgtctccacctccaaggagaggctcctcagtgtgcacctccc

SEQ ID NO: 2682 - DNA, 67 bp, Homo sapiens
ctaaggcacttgctggaagggcagaatgccagtgtgcttgcctatggacccacaggagctgggaaga

SEQ ID NO: 2683 - DNA, 73 bp, Homo sapiens
aattcctgctccaaaagaaagtcttcgaagccgctccactcgcatgtccactgtctcagagcttcgcatcacg

SEQ ID NO: 2684 - DNA, 66 bp, Homo sapiens
ccacagggttgaagaaccagaagccagttcctgctgttcctgtccagaagtctggcacatcaggtg

SEQ ID NO: 2685 - DNA, 79 bp, Homo sapiens
gtccccgggatggatgttttgccaagtcattgttggataagcgagatggtagtacaattgtcagacagcttgactgatc

SEQ ID NO: 2686 - DNA, 74 bp, Homo sapiens
gtgcaaccgcagcttctcgcgctctgaccacctggccctgcatatgaagaggcaccagaactgagcactgcccg

SEQ ID NO: 2687 - DNA, 67 bp, Homo sapiens
cacgagaccggctacttctcggcgctgccgtctctggaggagtactggcaacagacctgcctagagc

SEQ ID NO: 2688 - DNA, 78 bp, Homo sapiens
gcccagaggctccatcgtccatcctcttcctccccagtcggctgaactctccccttgtctgcactgttcaaacctctg

SEQ ID NO: 2689 - DNA, 78 bp, Homo sapiens
gacgtgagggtcctgattctccctggttttaccccagctccatccttgcatcactggggaggacgtgatgagtgagga

SEQ ID NO: 2690 - DNA, 70 bp, Homo sapiens
tgagagccaggcttcttgtatgtctcaaaatgccagccttctgaaagtatacagcaaagaggaccaggat

SEQ ID NO: 2691 - DNA, 71 bp, Homo sapiens
atgtgccagtgagcttgagtccttggagaaacacaagcacctgctagaaagtactgttaaccaggggctca

SEQ ID NO: 2692 - DNA, 72 bp, Homo sapiens
gagaccaaggttgcaaggccaggccctgtgtgaacctttgagctttcatagagagtttcacagcatggactg

SEQ ID NO: 2693 - DNA, 77 bp, Homo sapiens
tgagcggcagaatcaggagtaccagcggctcatggacatcaagtcgcggctggagcaggagattgccacctaccgca

SEQ ID NO: 2694 - DNA, 86 bp, Homo sapiens
ggatgaagcttacatgaacaaggtagagctggagtctcgcctggaagggctgaccgacgagatcaacttcctcaggcagctatatg

SEQ ID NO: 2695 - DNA, 73 bp, Homo sapiens
cagatgaggcacatggagacccaggccaaggacctgaggaatcagttgctcaactaccgttctgccatttcaa

SEQ ID NO: 2696 - DNA, 67 bp, Homo sapiens
actgaccaagcctgagacctactgcacccagtatggcgagtggcagatgaaatgctgcaagtgtgac

SEQ ID NO: 2697 - DNA, 80 bp, Homo sapiens
actcaagcggaaattgaagcagataggtcttatcagcacagtctccgcctcctggattcagtgtctcggcttcagggagt

SEQ ID NO: 2698 - DNA, 68 bp, Homo sapiens
gtgaacgttccggagagcggggagagcgcagaagcgtctctggatggcagccgggagtatgtgaatgt

SEQ ID NO: 2699 - DNA, 80 bp, Homo sapiens
cgctgggcaacattaagagttaccctggattaacgagttacctcgtccgagtggtgagcaccaactacaaccagcatgct

SEQ ID NO: 2700 - DNA, 67 bp, Homo sapiens
cagtgcctctcgcctgtcgactgggacaagcctgacagcagcggcacagagcaggatgacctcttca

SEQ ID NO: 2701 - DNA, 66 bp, Homo sapiens
gatgacggaaagcatccagatggaggcctctacaacaagggaccctcctactcgagttattccggg

SEQ ID NO: 2702 - DNA, 69 bp, Homo sapiens
agcggaaaatggcagacaatttttcgctccatgatgcgttatctgggtctggaaacccaaaccctcaag

SEQ ID NO: 2703 - DNA, 67 bp, Homo sapiens
ttggtgccgttcctatagatgatcctgaagatggaggcaagcactgggtggtgatcgtggcaggttc

SEQ ID NO: 2704 - DNA, 67 bp, Homo sapiens
cacctggtctgggaagatacctggaggttttgattggggtctcggtggccttcgtcctgctgctctt

SEQ ID NO: 2705 - DNA, 66 bp, Homo sapiens
tgcaaacgctggtgtcacagccagccccccaactgacctcatctggaagaaccagaactcgtgggg

SEQ ID NO: 2706 - DNA, 71 bp, Homo sapiens
cccatccagaacactgattgctgtcattcaagtgaaagggatggaggtcagaaagggtgcatagaaagcag

SEQ ID NO: 2707 - DNA, 66 bp, Homo sapiens
ccaatgggagaacaacgggcaggtgttcagcttgctgagcctgggctcacagtaccagcctcagcg

SEQ ID NO: 2708 - DNA, 66 bp, Homo sapiens
tcagcgggctcttaaacaaccagctgtccccgcagtaaagaagcctgcgtggtcaactcctgtctt

SEQ ID NO: 2709 - DNA, 67 bp, Homo sapiens
cgactatgacccactggacaagttcatctactgggtggatgggcgccagaacatcaagcgagccaag

SEQ ID NO: 2710 - DNA, 68 bp, Homo sapiens
ggatgtagccatctctgcctctatagacctcagggccttcgctgtgcttgccctattggctttgaact

SEQ ID NO: 2711 - DNA, 68 bp, Homo sapiens
aatgctgatgacttggagcaggccccacagaccccacagaggatgaagccaccccacagaggatgcag

SEQ ID NO: 2712 - DNA, 74 bp, Homo sapiens
tggttctgattaggtaacgtattggacctgcccacaactcccttgcacgtaaacttcagtgtcccaccttgacc

SEQ ID NO: 2713 - DNA, 67 bp, Homo sapiens
agaagctgtccctgcaagagcaggatgcagcgattgtgaagaacatgaagtctgagctggtacggct

SEQ ID NO: 2714 - DNA, 75 bp, Homo sapiens
ccgggagcagggaatcaccctgcgcgggagcgccgaaatcgtggccgagttcttctcattcggcatcaacagcat

SEQ ID NO: 2715 - DNA, 70 bp, Homo sapiens
gctgcctttggtaagaacatgtcgtccatcttgccattcacgccgccagttgtgaagagactgctgggat

SEQ ID NO: 2716 - DNA, 76 bp, Homo sapiens
ggacattactggcctgttcacaatgagcttgcattccagcctcccatttccaatcatcctgctcctgagtattggt

SEQ ID NO: 2717 - DNA, 72 bp, Homo sapiens
tccatcaaggctttcgactacgagaaggcgtacagcctgcagcggcccaatgaccacgagtttatgcagcag

SEQ ID NO: 2718 - DNA, 67 bp, Homo sapiens
cggaccaccaggtcagagccaattcgcagagcagggaagagtggtacctcaacacccactacccctg

SEQ ID NO: 2719 - DNA, 76 bp, Homo sapiens
gcctttcttacccagaagcagaaggtgggagaactgaaggatgacgactttgagaagatcagtgagctgggggctg

SEQ ID NO: 2720 - DNA, 71 bp, Homo sapiens
ggttggcatcaaaaggaactggtgcaggagagtttcagggacaattactggggacaattgcatttatggca

SEQ ID NO: 2721 - DNA, 76 bp, Homo sapiens
tgagtggaaaagcctgacctatgatgaagtcatcagctttgtgccaccaccccttgaccaagaagagatggagtcc

SEQ ID NO: 2722 - DNA, 77 bp, Homo sapiens
cagatggccactttgagaacattttagctgacaacagtgtgaacgaccagaccaaaatccttgtggttaatgctgcc

SEQ ID NO: 2723 - DNA, 75 bp, Homo sapiens
caaacgggctcatcataatgcactggaacgaaaacgtagggaccacatcaaagacagctttcacagtttgcggga

SEQ ID NO: 2724 - DNA, 75 bp, Homo sapiens
gacttttgcccgctacctttcattccggcgtgacaacaatgagctgttgctcttcatactgaagcagttagtggc

SEQ ID NO: 2725 - DNA, 75 bp, Homo sapiens
ggagaacaatccccttgagacagaatatggcctttctgtctacaaggatcaccagaccatcaccatccaggagat

SEQ ID NO: 2726 - DNA, 82 bp, Homo sapiens
tgatggtcctatgtgtcacattcatcacaggtttcataccaacacaggcttcagcacttcctttggtgtgtttcctgtccca

SEQ ID NO: 2727 - DNA, 71 bp, Homo sapiens
cgctcagccagatgcaatcaatgccccagtcacctgctgttataacttcaccaataggaagatctcagtgc

SEQ ID NO: 2728 - DNA, 66 bp, Homo sapiens
ggagccgactgcaagtacaagtttgagaactggggtgcgtgtgatgggggcacaggcaccaaagtc

SEQ ID NO: 2729 - DNA, 68 bp, Homo sapiens
ctacagggacgccatcgaatccggatcttgatgctggtgtaagtgaacattcaggtgattggttggat

SEQ ID NO: 2730 - DNA, 74 bp, Homo sapiens
ggagtcgaaggtggacaatcttgttgtcaatggcaccggaacaaactcaaccaactccactacagctgttccca

SEQ ID NO: 2731 - DNA, 69 bp, Homo sapiens
gtgaaatgaaacgcaccacactggacagccctttggggaagctggagctgtctggttgtgagcagggtc

SEQ ID NO: 2732 - DNA, 79 bp, Homo sapiens
acggatctaccacaccattgcatatttgacaccccttccccagccaaatagagctttgagtttttttgttggatatgga

SEQ ID NO: 2733 - DNA, 72 bp, Homo sapiens
gggagatcatcgggacaactctccttttgatggacctggaggaaatcttgctcatgcttttcaaccaggccc

SEQ ID NO: 2734 - DNA, 78 bp, Homo sapiens
ccaacgcttgccaaatcctgacaattcagaaccagctctctgtgaccccaatttgagttttgatgctgtcactaccgt

SEQ ID NO: 2735 - DNA, 86 bp, Homo sapiens
ccatgatggagaggcagacatcatgatcaactttggccgctgggagcatggcgatggatacccctttgacggtaaggacggactcc

SEQ ID NO: 2736 - DNA, 79 bp, Homo sapiens
ggatggtagcagtctagggattaacttcctgtatgctgcaactcatgaacttggccattctttgggtatgggacattcc

SEQ ID NO: 2737 - DNA, 67 bp, Homo sapiens
gagaaccaatctcaccgacaggcagctggcagaggaatacctgtaccgctatggttacactcgggtg

SEQ ID NO: 2738 - DNA, 79 bp, Homo sapiens
tcatggtgcccgtcaatgctgtgatggcgatgaagaccaagacgtatcaggtggcccacatgaagagcaaagacaatcg

SEQ ID NO: 2739 - DNA, 65 bp, Homo sapiens
aggggatgacttggacacatctgccattcgacatgactgcaattttgacaaagccatgcagtttt

SEQ ID NO: 2740 - DNA, 91 bp, Homo sapiens
tcatcctggcgatctacttcctctggcagaacctaggtccctctgtcctggctggagtcgctttcatggtcttgctgattccactcaacgg

SEQ ID NO: 2741 - DNA, 66 bp, Homo sapiens
agcgcctggaatctacaactcggagtccagtgttttcccacttgtcatcttctctccaggggctct

SEQ ID NO: 2742 - DNA, 66 bp, Homo sapiens
acttgcaggctgctatccttaacatgctgcccctgagagtaggaatgaccagggttcaagtctgct

SEQ ID NO: 2743 - DNA, 73 bp, Homo sapiens
gatgcagaattgaggcagactttacaagaagatttacttcgtcgattcccagatcttaaccgacttgccaaga

SEQ ID NO: 2744 - DNA, 82 bp, Homo sapiens
tgattaccatcatggctcagattggctcctatgttcctgcagaagaagcgacaattgggattgtggatggcattttcacaag

SEQ ID NO: 2745 - DNA, 68 bp, Homo sapiens
tctattgggggattggtaggaaccgttaccagctggaaattcctgagaatttcaccactcgcaatttg

SEQ ID NO: 2746 - DNA, 72 bp, Homo sapiens
gtgtgagaagtgtgccaaggactgtgtgtgcaaaggcggagaggcagctgaggcagaagcagagaagtgcag

SEQ ID NO: 2747 - DNA, 77 bp, Homo sapiens
ccgccctcacctgaagagaaacgcgctccttggcggacactgggggaggagaggaagaagcgcggctaacttattcc

SEQ ID NO: 2748 - DNA, 71 bp, Homo sapiens
ggccaggatctgtggtggtacaattgactctggccttccgagaaggtaccatcaatgtccacgacgtggag

SEQ ID NO: 2749 - DNA, 66 bp, Homo sapiens
ctatgagccatgtgggaaccggagcttcgagacctgcaggaccatcaacggcatccactccaacat

SEQ ID NO: 2750 - DNA, 67 bp, Homo sapiens
tgcccttgcactgtcctaacggctcagccatcctgcacacctacacccacgtggatgagtgtggctg

SEQ ID NO: 2751 - DNA, 67 bp, Homo sapiens
gtacgaccaagagaaacgggacctaccatggagaagacgggcagaagatgagatggacctggacagg

SEQ ID NO: 2752 - DNA, 75 bp, Homo sapiens
acgagaacgagggcatctatgtgcaggatgtcaagaccggaaaggtgcgcgctgtgattggaagcacctacatgc

SEQ ID NO: 2753 - DNA, 78 bp, Homo sapiens
gaaggaatgggaatcagtcatgagctaatcaccctggagatcagctcccgagatgtcccggatctgactctaatagac

SEQ ID NO: 2754 - DNA, 74 bp, Homo sapiens
agaaactggaggagcaggaccgccgggcactgagcatcaaggagcagctgcagcaggagcatcgtttcctgaag

SEQ ID NO: 2755 - DNA, 74 bp, Homo sapiens
gccgagatcgccaagatgttgccagggaggacagacaatgctgtgaagaatcactggaactctaccatcaaaag

SEQ ID NO: 2756 - DNA, 85 bp, Homo sapiens
cggtacttctcagggctaatatatacgtactctggcctcttctgcgtggtggtcaacccctataaacacctgcccatctactcgg

SEQ ID NO: 2757 - DNA, 73 bp, Homo sapiens
tgacggagcgtgagtgcatcaagtacatgcggcagatctcggagggagtggagtacatccacaagcagggcat

SEQ ID NO: 2758 - DNA, 73 bp, Homo sapiens
taactgacattcttgagcaccagatccgggctgttccctttgagaaccttaacatgcattgtgggcaagccat

SEQ ID NO: 2759 - DNA, 67 bp, Homo sapiens
ctctcccagcacagcttgaacctcactgagtcaaccagcctggacatgttgctggatgacactggtg

SEQ ID NO: 2760 - DNA, 77 bp, Homo sapiens
tagttcccagctgaccatcaaaaaggtggataagaacgacgaggctgagtacatctgcattgctgagaacaaggctg

SEQ ID NO: 2761 - DNA, 69 bp, Homo sapiens
ctactgcggaaagtcggggcactggagtccaaactcgcttcctgccggaacctcgtgtacgatcagtcc

SEQ ID NO: 2762 - DNA, 67 bp, Homo sapiens
agggcaacattccacagctgccctggctgtgatgagtgtccttgcaggggccggagtaggagcactg

SEQ ID NO: 2763 - DNA, 66 bp, Homo sapiens
tatccatcctgatggcgtcatcccagtgctgactttcctcagggatcacaccaatgcacagttcaa

SEQ ID NO: 2764 - DNA, 69 bp, Homo sapiens
tgctggctactgggtgttagtttgcagtcctgtgtgcttccctctcttatgactgtgtccctggttgtc

SEQ ID NO: 2765 - DNA, 79 bp, Homo sapiens
gtgaggcagcgcgactctggcgactggccggccatgccttcccgggctgaggactatgaagtgttgtacaccattggca

SEQ ID NO: 2766 - DNA, 68 bp, Homo sapiens
actccagagctgacctccaccgcccagcctgggaagtcattgtagggagtgagacactgaagccctga

SEQ ID NO: 2767 - DNA, 73 bp, Homo sapiens
cagaccaaggagatggacctcagcgtggtgcggctcatgtttacagcttttcttccggatagcactggcagct

SEQ ID NO: 2768 - DNA, 68 bp, Homo sapiens
ctgccgggatggcttctatgaggctgagctctgcccggaccgctgcatccacagtttccagaacctgg

SEQ ID NO: 2769 - DNA, 78 bp, Homo sapiens
ccaaggaatcatgttcgttcaggaggaggccctggccagcagcctctcgtccactgacagtctgactcccgagcacca

SEQ ID NO: 2770 - DNA, 67 bp, Homo sapiens
gagagagtgagcgaaccctgcccaggctccaagaagcagctgaagtttgaagagctccagtgcgacg

SEQ ID NO: 2771 - DNA, 70 bp, Homo sapiens
ggctgctggtacaaatactgcagaaatgacaccaataataggggcagacacaacagcgtggcttagattg

SEQ ID NO: 2772 - DNA, 83 bp, Homo sapiens
tgatccatctctaggccacatgattgtcaccttagttgcccgggttctcagttttggcaattcttgtgtcaacccatttgctc

SEQ ID NO: 2773 - DNA, 74 bp, Homo sapiens
ccaaccctgcagactccaagcctgggaccatccgtggagacttctgcatacaagttggcaggaacattatacat

SEQ ID NO: 2774 - DNA, 68 bp, Homo sapiens
atctccgcctcgctcatgggcacggtgatggcgaagcgagtgaaggcgacaatcctgtatggctccga

SEQ ID NO: 2775 - DNA, 76 bp, Homo sapiens
cgggtccaccagtttgaatggtcaatgcgagtggctgtcccggctgcagagcggcatggtgccgaaccaatacaac

SEQ ID NO: 2776 - DNA, 75 bp, Homo sapiens
cacttccctgctgggattatatcaacaaccagtgtgatgagctgtgcaacacggtcgagtgcctgtttgacaact

SEQ ID NO: 2777 - DNA, 84 bp, Homo sapiens
aatgttgtccaggttctattgccaagaatgtgttgtccaaaatgcctgtttagtttttaaagatggaactccaccctttgcttg

SEQ ID NO: 2778 - DNA, 69 bp, Homo sapiens
cacagcttgcttgtcgatgtccctgccttcgcctgcctctctgcccttgtcctcatcaccgaccggcat

SEQ ID NO: 2779 - DNA, 83 bp, Homo sapiens
cgagactctcctcatagtgaaaggtatgtgtcagccatgaccaccccggctcgtatgtcacctgtagatttccacacgccaag

SEQ ID NO: 2780 - DNA, 82 bp, Homo sapiens
cagctctctccacgcgattcatcaggatctaccccgagagagccactcatggcggactggggctcagaatggagctgctggg

SEQ ID NO: 2781 - DNA, 76 bp, Homo sapiens
ctacagcctaaacggcaaggactgggaatacattcaggaccccaggacccagcagccaaagctgttcgaagggaac

SEQ ID NO: 2782 - DNA, 69 bp, Homo sapiens
agaaggactatgccgtccagatccacatcctgaaggcggacaaggcgggggactggtggaagttcacgg

SEQ ID NO: 2783 - DNA, 75 bp, Homo sapiens
gcttccacatcgtggtattggagacagtcttctgataggtttcctcggcatcagaagtccttcaaccctgcagtt

SEQ ID NO: 2784 - DNA, 80 bp, Homo sapiens
agagatcaccggcgtaatcaacccagcgttggacaaatactttccgtcagactctggagtgagaatcatagctgagcccg

SEQ ID NO: 2785 - DNA, 80 bp, Homo sapiens
caaccgaagttttcactccagttgtccccacagtagacacatatgatggccgaggtgatagtgtggtttatggactgagg

SEQ ID NO: 2786 - DNA, 66 bp, Homo sapiens
tccttgaccataccggagggtgcatgtacatctccggtgtccctgggacagggaagactgccactg

SEQ ID NO: 2787 - DNA, 68 bp, Homo sapiens
gtttctgaaggggaggtcacagcctgagctggcctcctatgcctcatcatgtcccaaaccagacacct

SEQ ID NO: 2788 - DNA, 77 bp, Homo sapiens
gctcatcatggtcatgtgctacttgaaaagtcagtggatcaaggagacctgttatcctgacatccctgacccttaca

SEQ ID NO: 2789 - DNA, 72 bp, Homo sapiens
ccctcgtgctgatgctactgaggagccagcgtctagggcagcagccgcttcctagaagaccaggtcatgatg

SEQ ID NO: 2790 - DNA, 76 bp, Homo sapiens
gcggaaggtccctcagacatccccgattgaaagaaccagagaggctctgagaaacctcgggaaacttagatcatca

SEQ ID NO: 2791 - DNA, 65 bp, Homo sapiens
tggagactctcagggtcgaaaacggcggcagaccagcatgacagatttctaccactccaaacgcc

SEQ ID NO: 2792 - DNA, 66 bp, Homo sapiens
cggtggaccacgaagagttaacccgggacttggagaagcactgcagagacatggaagaggcgagcc

SEQ ID NO: 2793 - DNA, 68 bp, Homo sapiens
ctttgaacccttgcttgcaataggtgtgcgtcagaagcacccaggacttccatttgctttgtcccggg

SEQ ID NO: 2794 - DNA, 77 bp, Homo sapiens
cccagctagtgttcctcagaacaaagattggaaaaagctggccgagaaccatttatacatagaggaagggcttacgg

SEQ ID NO: 2795 - DNA, 71 bp, Homo sapiens
agcagtggcttgctttcttctcctgtgatgtcccagtttcccactctgaagatcccaacatggtcctagca

SEQ ID NO: 2796 - DNA, 81 bp, Homo sapiens
ccgcaacgtggttttctcaccctatggggtggcctcggtgttggccatgctccagctgacaacaggaggagaaacccagca

SEQ ID NO: 2797 - DNA, 70 bp, Homo sapiens
gagctgtgggttgttatggaatacttggctggaggctccttgacagatgtggtgacagaaacttgcatgg

SEQ ID NO: 2798 - DNA, 65 bp, Homo sapiens
ggagctgacctgcttcctacatcgcctggcctcgatgcataaggactatgctgtggtgctctgct

SEQ ID NO: 2799 - DNA, 69 bp, Homo sapiens
aggtggctgtgttactgcaacgtgccacagttctgcgacagtctacctcggtacgaaaccacacaggtg

SEQ ID NO: 2800 - DNA, 71 bp, Homo sapiens
gaaggtgttggaggcactcaaggacctcatcaacgaggcctgctgggatattagctccagcggtgtaaacc

SEQ ID NO: 2801 - DNA, 67 bp, Homo sapiens
ttgttggtgtgccctggtgccgtggtggcggtcactccctctgctgccagtgtttggacagaaccca

SEQ ID NO: 2802 - DNA, 62 bp, Homo sapiens
actgaaggagacccttggagcctaggggcatcggcaggagagtgtgtgggcagggttattta

SEQ ID NO: 2803 - DNA, 79 bp, Homo sapiens
agttactaaaaaataccacgaggtccttcagttgagaccaaagaccggtgtcaggggattgcacaaatcactcaccgac

SEQ ID NO: 2804 - DNA, 74 bp, Homo sapiens
tatcgaggcaggtcataccatgaccggaagtcaaaagttgacctggataggctcaatgatgatgccaagcgtta

SEQ ID NO: 2805 - DNA, 72 bp, Homo sapiens
gggagtttccaagagatggactagtgcttggtcgggtcttggggtctggagcgtttgggaaggtggttgaag

SEQ ID NO: 2806 - DNA, 66 bp, Homo sapiens
ccagctctccttccagctacagatcaatgtccctgtccgagtgctggagctaagtgagagccaccc

SEQ ID NO: 2807 - DNA, 68 bp, Homo sapiens
ggaaaacgttcgtcaacatcacgccagctgaggtgggtgtcctggttggcaaagaccggtcaagtttt

SEQ ID NO: 2808 - DNA, 82 bp, Homo sapiens
tctatacgtcgatggtgactgcacaatggacatccggacaaagagtcaaggtggggagccaacatacaatgtggctgtcggc

SEQ ID NO: 2809 - DNA, 74 bp, Homo sapiens
agagccagttgctgtagaactcaaatctctgctgggcaaggatgttctgttcttgaaggactgtgtaggcccag

SEQ ID NO: 2810 - DNA, 98 bp, Homo sapiens
tgctacctggacagcccgttggtgcgcttcctcctgaaacgagctgtgtctgacttgagagtgactcactacttcttctggttactgaaggacggcct

SEQ ID NO: 2811 - DNA, 83 bp, Homo sapiens
ataccaatcaccgcacaaacccaggctatttgttaagtccagtcacagcgcaaagaaacatatgcggagaaaatgctagtgtg

SEQ ID NO: 2812 - DNA, 67 bp, Homo sapiens
gtgattgaagagcatgccaattggtctgtatcccgagaagcaggatttagctattcccacgcaggac

SEQ ID NO: 2813 - DNA, 67 bp, Homo sapiens
ctgctcaaggacaccgtctacacggacttcgatgggacccgagtgtatagccctccagagtggatcc

SEQ ID NO: 2814 - DNA, 68 bp, Homo sapiens
gatcaacggctacatccagaagatcaagtcgggagaggaggactttgagtctctggcctcacagttca

SEQ ID NO: 2815 - DNA, 68 bp, Homo sapiens
cagcaccagcgattacgacgttggctgggagagtcctcacaatggctcggggacgtgggcctattcag

SEQ ID NO: 2816 - DNA, 68 bp, Homo sapiens
ccgcctggacattgattcaccacccatcacagcccggaacactggcatcatctgtaccattggcccag

SEQ ID NO: 2817 - DNA, 79 bp, Homo sapiens
gcatccctcacccatcctagaggccaggcaggagcccttctatacccacccagaatgagacatccagcagatttccagc

SEQ ID NO: 2818 - DNA, 76 bp, Homo sapiens
cccatggatgctcctctgaagagactttcctcattgactgccgaggccccatgaatcaatgtctggtagccaccgg

SEQ ID NO: 2819 - DNA, 69 bp, Homo sapiens
aatgaatacagtattcccaagcacatcaaccccgtggccgcctccctcatccagaagatgcttcagaca

SEQ ID NO: 2820 - DNA, 66 bp, Homo sapiens
tgaaggagacgtaccgctgcatcaagcaggttcactacacgctgcctgccagcctctcactgcctg

SEQ ID NO: 2821 - DNA, 84 bp, Homo sapiens
cagggaggtggttgcaaatttctaaggtacaattgctctattgagtcaccacgaaaaggctggagcttcatgcatcctgggaga

SEQ ID NO: 2822 - DNA, 77 bp, Homo sapiens
cttacggttttcgtggagaagccttggggtcaatttgttgtatagctgaggttttaattacaacaagaacggctgct

SEQ ID NO: 2823 - DNA, 75 bp, Homo sapiens
gatgtggactgccattcaaaccaggaagataccggatgtaaatttcgagttttgcctcagccaactaatctcgca

SEQ ID NO: 2824 - DNA, 72 bp, Homo sapiens
tgactttatggagcccaagtttgagtttgctgtgaagttcaatgcactggaattagatgacagcgacttggc

SEQ ID NO: 2825 - DNA, 71 bp, Homo sapiens
tcctcatttggatgggaaacatgtggtgtttggccaagtaattaaaggaataggagtggcaaggatattgg

SEQ ID NO: 2826 - DNA, 62 bp, Homo sapiens
gccatccgcaaaggctttctcgcttgtcaccttgccatgtggaagaaactggcggaatggcc

SEQ ID NO: 2827 - DNA, 74 bp, Homo sapiens
ggctcagagcataaggcttcagggcccaagttgggagaagtgaccaaagtgtagccagttttctgagttcccgt

SEQ ID NO: 2828 - DNA, 85 bp, Homo sapiens
gcatcaggctgtcattatggtgtccttacctgtgggagctgtaaggtcttctttaagagggcaatggaagggcagcacaactact

SEQ ID NO: 2829 - DNA, 69 bp, Homo sapiens
ggtgtccttcgccagatcactgttaatgatttgcctgtgggacgctccgtggatgaggctctgcggctg

SEQ ID NO: 2830 - DNA, 80 bp, Homo sapiens
tgaccccaatggagtcatcaagcatttgagcgtcaacgatctcccagtgggccgaagcgtggaagaaaccctccgcttgg

SEQ ID NO: 2831 - DNA, 75 bp, Homo sapiens
ttacccatttggcctggattaatacccctcgaagacaaggaggacttgggccaataaggattccacttctttcag

SEQ ID NO: 2832 - DNA, 76 bp, Homo sapiens
ctgtgagccagaggatgtcagctgccaattgtgttttcctgcagcaattccataaacacatcctggtgtcatcaca

SEQ ID NO: 2833 - DNA, 70 bp, Homo sapiens
caagcaatgcgtcatcaatgtccccagcctctgcggaatggatcacactgagaagagggggcggatttac

SEQ ID NO: 2834 - DNA, 67 bp, Homo sapiens
gacccagctccactcctgcttccagaccatggaccgcctgtactttgtgatggagtacgtgaatggg

SEQ ID NO: 2835 - DNA, 68 bp, Homo sapiens
ctgacacttgccgcagagaatccctttctcacccacctcatctgcaccttccagaccaaggaccacct

SEQ ID NO: 2836 - DNA, 84 bp, Homo sapiens
gcgatacatgagcccagaacagatttcttcgcaagactatggaaaggaagtggacctctacgctttggggctaattcttgctga

SEQ ID NO: 2837 - DNA, 86 bp, Homo sapiens
gccctcccagtgtgcaaataagggctgctgtttcgacgacaccgttcgtggggtcccctggtgcttctatcctaataccatcgacg

SEQ ID NO: 2838 - DNA, 66 bp, Homo sapiens
ccacgacaaagccgactacatgcctgaaacaaggctgagaatcccggcagcagagcccatcgagta

SEQ ID NO: 2839 - DNA, 81 bp, Homo sapiens
tggctaagtgaagatgacaatcatgttgcagcaattcactgtaaagctggaaagggacgaactggtgtaatgatatgtgca

SEQ ID NO: 2840 - DNA, 78 bp, Homo sapiens
taactggggcaaccttttcttcgcctctgcctttgccttcctggggctcttggcgctgacagtcaccttttcctgcaa

SEQ ID NO: 2841 - DNA, 83 bp, Homo sapiens
agtgactgggagtgggctagaaggggaccacctgtctgacacctccacaacgtcgctggagctcgattcacggtaacaggctt

SEQ ID NO: 2842 - DNA, 73 bp, Homo sapiens
cgaggtacaagctgagatcaagaaatcttggagccgctggacactggcactggacttcaagcgaaaggcacgc

SEQ ID NO: 2843 - DNA, 68 bp, Homo sapiens
gaccggtcgaatgataaggtgtacgagaatgtgacgggcctggtgaaagctgtcatcgagatgtccag

SEQ ID NO: 2844 - DNA, 74 bp, Homo sapiens
caagcccagccgacctaagtacagaccccctccgcaaaccaacctcctggctccaaagctgcagttccaggttc

SEQ ID NO: 2845 - DNA, 70 bp, Homo sapiens
aatatttgtgcggggtatgggggtgggtttttaaatctcgtttctcttggacaagcacagggatctcgtt

SEQ ID NO: 2846 - DNA, 68 bp, Homo sapiens
cctgttctcggcaccttaaattattagaccccggggcagtcaggtgctccggacacccgaaggcaata

SEQ ID NO: 2847 - DNA, 81 bp, Homo sapiens
cgcttgcctaactcatactttcccgttgacacttgatccacgcagcgtggcactgggacgtaagtggcgcagtctgaatgg

SEQ ID NO: 2848 - DNA, 74 bp, Homo sapiens
aatgaggaagtttcggatggggctgatccagacagccgaccagctgcgcttctcctacctggctgtgatcgaag

SEQ ID NO: 2849 - DNA, 78 bp, Homo sapiens
tgttttagctgagggacgtggtgccgacgtccccaaacctagctaggctaagtcaagatcaacattccagggttggta

SEQ ID NO: 2850 - DNA, 75 bp, Homo sapiens
aacttccggtacctcgttcgtgactacatgaagcagagtcctcccgaatcgccgattctggtgcattgcagtgct

SEQ ID NO: 2851 - DNA, 66 bp, Homo sapiens
catggcctgatcatggtgtgcccacagcaaatgctgcagaaagtatcctgcagtttgtacacatgg

SEQ ID NO: 2852 - DNA, 74 bp, Homo sapiens
ggctactctgatctatgttgataaggaaaatggagaaccaggcacccgtgtggttgctaaggatgggctgaagc

SEQ ID NO: 2853 - DNA, 79 bp, Homo sapiens
cctgcagctgtgggacatcgcggggcaggagcgatttggcaacatgacccgagtatactacaaggaagctgttggtgct

SEQ ID NO: 2854 - DNA, 78 bp, Homo sapiens
gcgacagctcctctagttccaccatgtccgcgggcggagacttcgggaatccgctgaggaaattcaagctggtgttcc

SEQ ID NO: 2855 - DNA, 66 bp, Homo sapiens
tgttgtaaatgtctcagcccctcgttcttggtcctgtcccttggaacctttgtacgctttgctcaa

SEQ ID NO: 2856 - DNA, 78 bp, Homo sapiens
gaacttcttgagcaggagcatacccagggcttcataatcaccttctgttcagcactagatgatattcttgggggtgga

SEQ ID NO: 2857 - DNA, 67 bp, Homo sapiens
agctagcctcagtgacacacatgacaggttgcactgccgacgttgtgtcaacagccgtcagatccgg

SEQ ID NO: 2858 - DNA, 73 bp, Homo sapiens
cgtcgtatgcgagagtctgtttccaggatgcctgttagttctcagcacagatattctacacctcacgccttca

SEQ ID NO: 2859 - DNA, 84 bp, Homo sapiens
ggtgtcagatataaatgtgcaaatgccttcttgctgtcctgtcggtctcagtacgttcactttatagctgctggcaatatcgaa

SEQ ID NO: 2860 - DNA, 73 bp, Homo sapiens
tccttcagctttcacactgggctcagaaatgaagttgcatgactcttctggaagtcaggtgggaacaggattt

SEQ ID NO: 2861 - DNA, 81 bp, Homo sapiens
aacatgattatccaagccgctggactgccattgtggacaaaattggcttttatcttcagtccgataacagtgcttgttggc

SEQ ID NO: 2862 - DNA, 79 bp, Homo sapiens
caagtcagttgagacgccagttgtgtggaggaagtcaggccgccatagaaagaatgatccactttggacgagagctgca

SEQ ID NO: 2863 - DNA, 67 bp, Homo sapiens
tgtggatgctggattgatttcaccactggtgcagctgctaaatagcaaagaccaggaagtgctgctt

SEQ ID NO: 2864 - DNA, 80 bp, Homo sapiens
agtctgtgagaaacgaccgaaacaagaagaagaaggaggtgcccaagcccgagtgctctgagagctacacgctgacgccg

SEQ ID NO: 2865 - DNA, 78 bp, Homo sapiens
tgcctggacatcctgattcttagaatttgcaccaggtataccccagaacaagacaccatgactttctcagacggcctt

SEQ ID NO: 2866 - DNA, 69 bp, Homo sapiens
agtgggagacacctgacctttctcaagctgagattgagcagaagatcaaggagtacaatgcccagatca

SEQ ID NO: 2867 - DNA, 69 bp, Homo sapiens
cgagagggagagcaagaccatcatgctgcgcggccttcccatcaccatcacagagagcgatattcgaga

SEQ ID NO: 2868 - DNA, 79 bp, Homo sapiens
ggaaccacattatggatctttgcatagaatgtcaagctaaccaggcgtccgctacttcagaagagtgtactgtcgcatg

SEQ ID NO: 2869 - DNA, 66 bp, Homo sapiens
gggctgggtgagaatgtgatggagaggaagaagccggccctggtatccattccggaggatgttgtg

SEQ ID NO: 2870 - DNA, 83 bp, Homo sapiens
tgctaactcctgcacagccccgtcctcttcctttctgctagcctggctaaatctgctcattatttcagaggggaaacctagca

SEQ ID NO: 2871 - DNA, 96 bp, Homo sapiens
tcaagaccatcatcactttcattgtctcggacgtgcggggcctgggcctcccggtccgcaagcagttccagttatactccgtgtacttcctgatcc

SEQ ID NO: 2872 - DNA, 67 bp, Homo sapiens
aagcatgaacaggacttgaccatctttccaacccctggggaagacatttgcaactgacttggggagg

SEQ ID NO: 2873 - DNA, 68 bp, Homo sapiens
cccgttcggtctgaggaaggccgggacatggcgaaccggatcagtgcctttggctaccttgagtgctc

SEQ ID NO: 2874 - DNA, 74 bp, Homo sapiens
ccagacgagcgattagaagcggcagcttgtgaggtgaatgatttgggggaagaggaggaggaggaagaggagga

SEQ ID NO: 2875 - DNA, 79 bp, Homo sapiens
accctggaagagatggatcagaaaaaaagatccgggagtgtgtgatctgtatgatggactttgtttatggggacccaat

SEQ ID NO: 2876 - DNA, 73 bp, Homo sapiens
tgtgcacataggaatgagcttcagatgcagttggccagcaaagagagtgatattgagcaattgcgtgctaaac

SEQ ID NO: 2877 - DNA, 66 bp, Homo sapiens
gatccgagaccctcgctcccccatcaacgtggagagcttgctggatggcttaaattccttggtcct

SEQ ID NO: 2878 - DNA, 75 bp, Homo sapiens
ccattctatcatcaacgggtacaaacgagtcctggccttgtctgtggagacggattacaccttcccacttgctga

SEQ ID NO: 2879 - DNA, 73 bp, Homo sapiens
cagtcggctttaccctatcgacgcagcgtccccacttggttgaagttgacatctgacgacgtgaaggagcaga

SEQ ID NO: 2880 - DNA, 66 bp, Homo sapiens
gggctactggcagctacattgctgggactaatggcaattccaatggccttgtaccgatgctgagag

SEQ ID NO: 2881 - DNA, 71 bp, Homo sapiens
cagcgggattaaacagtcctttaaccagcacagccagttaaaagatgcagcctcactgcttcaacgcagat

SEQ ID NO: 2882 - DNA, 74 bp, Homo sapiens
gactggagtggtgtttggtgccagcctattcctgctgctttcattgacagtattcagcattgtgagcgtaacag

SEQ ID NO: 2883 - DNA, 69 bp, Homo sapiens
aacagagacattgccaaccatattggatctgcttgctgtccaaaccagcaaacttcctgggcaaatcac

SEQ ID NO: 2884 - DNA, 66 bp, Homo sapiens
gctctgttgtgtcctgttgccggctctggccttcctgtgactgactgtgaagtggcttctccgtac

SEQ ID NO: 2885 - DNA, 70 bp, Homo sapiens
tggacaaggtgatgaaggagctagacgagaatggagacggggaggtggacttccaggagtatgtggtgct

SEQ ID NO: 2886 - DNA, 73 bp, Homo sapiens
tggctgtgctggtcactaccttccacaagtactcctgccaagagggcgacaagttcaagctgagtaaggggga

SEQ ID NO: 2887 - DNA, 70 bp, Homo sapiens
gactgctgtcatggcgtgccctctggagaaggccctggatgtgatggtgtccaccttccacaagtactcg

SEQ ID NO: 2888 - DNA, 76 bp, Homo sapiens
actccctgataaaggggaatttccatgccgtctacagggatgacctgaagaaattgctagagaccgagtgtcctca

SEQ ID NO: 2889 - DNA, 65 bp, Homo sapiens
ctttgggacagagtgcaagacgatgacttgcaaaatgtcgcagctggaacgcaacatagagacca

SEQ ID NO: 2890 - DNA, 67 bp, Homo sapiens
agacaaggatgccgtggataaattgctcaaggacctggacgccaatggagatgcccaggtggacttc

SEQ ID NO: 2891 - DNA, 67 bp, Homo sapiens
ccttttaccactgcctggttgcagaagtgccgaaagagcactggactccggaaggacacagcattgt

SEQ ID NO: 2892 - DNA, 67 bp, Homo sapiens
ggactcaacgatgggcagatcaagatctgggaggtgcagacagggctcctgcttttgaatctttccg

SEQ ID NO: 2893 - DNA, 76 bp, Homo sapiens
gaaattgacgaggggtgtcttgggcagagctggctctgagcgcctccatccaaggccaggttctccgttagctcct

SEQ ID NO: 2894 - DNA, 71 bp, Homo sapiens
gctccaggatgtgtttctgttgtcctcgcgggaccaccggaccccgctgctctatgccgtcttctccacgt

SEQ ID NO: 2895 - DNA, 86 bp, Homo sapiens
cgcgagcccctcattatacactgggcagcctccccacagcgcatcgaggaatgcgtgctctcaggcaaggatgtcaacggcgagtg

SEQ ID NO: 2896 - DNA, 63 bp, Homo sapiens
ttccagcccaacacagtgaacactttggcctgcccgctcctctccaacctggcgacccgactc

SEQ ID NO: 2897 - DNA, 66 bp, Homo sapiens
caagctgaacggtgtgtccgaaagggacctgaagaaatcggtgctgtggctcaaagacagcttgca

SEQ ID NO: 2898 - DNA, 67 bp, Homo sapiens
tacaggatgaggctgggcattgcctgggacagcctatgtaaggccatgtgccccttgccctaacaac

SEQ ID NO: 2899 - DNA, 77 bp, Homo sapiens
cagtggagaccagttgggtagtggtgactgggtacgctacaagctctgcatgtgtgctgatgggacgctcttcaagg

SEQ ID NO: 2900 - DNA, 71 bp, Homo sapiens
ccaacaccttcttggcttctgggacctgtgttcttgctgagcaccctctccggtttgggttgggataacag

SEQ ID NO: 2901 - DNA, 70 bp, Homo sapiens
gtccaaggcacatatccactgctcggtgaaagcagagaactcggtggcggccaaatcgggaggctgcttc

SEQ ID NO: 2902 - DNA, 77 bp, Homo sapiens
aacggactccctcaatttgtgcaagatttgcatgaccatggacagaaatatgtcatcatcttggaccctgcaatttc

SEQ ID NO: 2903 - DNA, 67 bp, Homo sapiens
ttggcattggaactacattcaatccgcggtatcctcggattagttctaggacccccttctccatacc

SEQ ID NO: 2904 - DNA, 65 bp, Homo sapiens
aaccacagttggaggaggacggcagagacagtttccctccccgctataccaacacccttccttcg

SEQ ID NO: 2905 - DNA, 70 bp, Homo sapiens
tccagcccaaatcctcctggtggcacatcctaccccagatgctaaagtgattcaaggactccaggacacc

SEQ ID NO: 2906 - DNA, 66 bp, Homo sapiens
gatggtaggaagggatgtgcccgcctctccacgcactcagctatacctcattcacagctccttgtg

SEQ ID NO: 2907 - DNA, 74 bp, Homo sapiens
ccagagtcatgctcatccagccccaccagttgcaccagtgcagggacagcagcaatttcagaggctgaaggtgg

SEQ ID NO: 2908 - DNA, 72 bp, Homo sapiens
agctggggtgtctgtttcatgtggaatacctgacttcaggtcaagggatggtatttatgctcgccttgctgt

SEQ ID NO: 2909 - DNA, 76 bp, Homo sapiens
ccattgcctttgctttgttcataatttcagcagggcagaataaaaaccatgggaggcaaagaaaggaaatccggaa

SEQ ID NO: 2910 - DNA, 71 bp, Homo sapiens
agttgcagaatctaagcctggaaggcctgcggctttcggatcccattgtcaatactctcgcaaaaaactca

SEQ ID NO: 2911 - DNA, 64 bp, Homo sapiens
tctgccagtgctgaattctttgctgacattgccctggctcctatggaagctgctaaggttcgaa

SEQ ID NO: 2912 - DNA, 67 bp, Homo sapiens
gcctgagtctcctgtgcccacatcccaggcttcaccctgaatggttccatgcctgagggtggagact

SEQ ID NO: 2913 - DNA, 66 bp, Homo sapiens
ccgttcgaagagtcgtgagggggtgacgggttaagattcggagagagaggtgctagtggctggact

SEQ ID NO: 2914 - DNA, 75 bp, Homo sapiens
cctgctttcaaccacattgaattgaactcagatcagagtggcaagagcaatgggactcgtttgtgaagctgctct

SEQ ID NO: 2915 - DNA, 70 bp, Homo sapiens
gcgcagaggccagttaaagtagatcacctcctcgaacccactccggttccccgcaacccacagctcagct

SEQ ID NO: 2916 - DNA, 74 bp, Homo sapiens
atggccaatgtttgatgcttaacccccccaatttctgtgagatggatggccagtgcaagcgtgacttgaagtgt

SEQ ID NO: 2917 - DNA, 66 bp, Homo sapiens
agggactgtcctggcacattatgcagatgtcctgggtcttttgcttagactgcggcaaatttgttg

SEQ ID NO: 2918 - DNA, 69 bp, Homo sapiens
cccaatcggaagcctaactacagcgagctgcaggactctaatccagagtttaccttccagcagccctac

SEQ ID NO: 2919 - DNA, 76 bp, Homo sapiens
ggctggccaaacataagcagctgcactgcgatgcccagtctagaaaatctttcagctgtaaatactgtgacaagga

SEQ ID NO: 2920 - DNA, 79 bp, Homo sapiens
ggctggtcggcagagagtagcctgcaacattcggccgtggtttacatgagtttacccctcaatcccaaacctttcctca

SEQ ID NO: 2921 - DNA, 70 bp, Homo sapiens
tgaagagaggcatgttggagacttgggcaatgtgactgctgacaaagatggtgtggccgatgtgtctatt

SEQ ID NO: 2922 - DNA, 78 bp, Homo sapiens
gcttgtccaaatcaggatccactgcaaggaacaacaggccttattccactgctggggattgatgtgtgggagcacgct

SEQ ID NO: 2923 - DNA, 65 bp, Homo sapiens
tctgcaccaaattctccaagaacaccgttaacacctccgcctgcttctggtgcttccagtaccac

SEQ ID NO: 2924 - DNA, 67 bp, Homo sapiens
tcgtgtgcaagcctgagatgggcctcccctaccaggggcatgactccggtgtgaatctccccgacag

SEQ ID NO: 2925 - DNA, 73 bp, Homo sapiens
tcttccctgtacactggcagttcggccagctggaccagcaccccattgacgggtacctctcccacaccgagct

SEQ ID NO: 2926 - DNA, 68 bp, Homo sapiens
aggaatgcagcggattcctctgtcccaagtgctcccagaaggcaggattctgaagaccactccagcga

SEQ ID NO: 2927 - DNA, 77 bp, Homo sapiens
cagaccagtccctggtcataggtctgaaagggcaatccggacccagcccaagcaactgattgtggatgacttgaagg

SEQ ID NO: 2928 - DNA, 66 bp, Homo sapiens
tgtggcaagtgcaaatgtaaggagtgcacctacccaaggcctctgccatcagactggatctgcgac

SEQ ID NO: 2929 - DNA, 79 bp, Homo sapiens
agatggaagaagccaacctggcgagccgagcgaaggcccaggagctgatccaggccaccaaccagatcctcagccacag

SEQ ID NO: 2930 - DNA, 63 bp, Homo sapiens
tgactgcacatggaacattgaggtgcccaacaaccagcatgtgaaggtgcgcttcaaattctt

SEQ ID NO: 2931 - DNA, 81 bp, Homo sapiens
gggctcagctttcagaagtgctgagttggcagttttcttctgtcaccaaaagaggtctcaatgtggaccagctgaacatgt

SEQ ID NO: 2932 - DNA, 70 bp, Homo sapiens
tcacatgccactttggtgtttcataatctcctgggagagattgaccagcagtatagccgcttcctgcaag

SEQ ID NO: 2933 - DNA, 77 bp, Homo sapiens
gaggcgctcaacatgaaattcaaggccgaagtgcagagcaaccggggcctgaccaaggagaacctcgtgttcctggc

SEQ ID NO: 2934 - DNA, 74 bp, Homo sapiens
ccagtggtggtgatcgttcatggcagccaggacaacaatgcgacggccactgttctctgggacaatgcttttgc

SEQ ID NO: 2935 - DNA, 72 bp, Homo sapiens
ctccgaggtgaggaggactctccctcccacatcaaacgcacatcccatgagagtgcataaccagggagaggt

SEQ ID NO: 2936 - DNA, 66 bp, Homo sapiens
ggactcggagacgctgtgcaggagggccgtcaagatcctcaagaagaagaagttgcgaaggatccc

SEQ ID NO: 2937 - DNA, 69 bp, Homo sapiens
catcttccaggaggaccactctctgtggcaccctggactacctgccccctgaaatgattgaaggtcgga

SEQ ID NO: 2938 - DNA, 71 bp, Homo sapiens
aatacccaacgcacaaatgaccgcacgttctctgccccgtttcttgccccagtgtggtttgcattgtctcc

SEQ ID NO: 2939 - DNA, 90 bp, Homo sapiens
cctggaggctgcaacatacctcaatcctgtcccaggccggatcctcctgaagcccttttcgcagcactgctatcctccaaagccattgta

SEQ ID NO: 2940 - DNA, 74 bp, Homo sapiens
gaagatccctttcctcctactgttctttctgtgggaagccgagagccacgaagcatcaaggccgaacatcatcc

SEQ ID NO: 2941 - DNA, 80 bp, Homo sapiens
tgttttgattcccgggcttaccaggtgagaagtgagggaggaagaaggcagtgtcccttttgctagagctgacagctttg

SEQ ID NO: 2942 - DNA, 73 bp, Homo sapiens
gatggagcaggtggctcagttcctgaaggcggctgaggactctggggtcatcaagactgacatgttccagact

SEQ ID NO: 2943 - DNA, 65 bp, Homo sapiens
gcccgaaacgccgaatataatcccaagcggtttgctgcggtaatcatgaggataagagagccacg

SEQ ID NO: 2944 - DNA, 67 bp, Homo sapiens
gaggtcctgagcactgccaggagggacaaaggagcctgtgaacccaggacaagcatggtcccacatc

SEQ ID NO: 2945 - DNA, 67 bp, Homo sapiens
gcagctgcagtcaacagttcaaagaagtcatggcccaaatccagtgtgcacccctccccattcacag

SEQ ID NO: 2946 - DNA, 68 bp, Homo sapiens
ccgggacactttccagaagccgcgggactatttcgccgaagtgagaaggcctcaggacagcgcgttct

SEQ ID NO: 2947 - DNA, 67 bp, Homo sapiens
ccaatcacgacaggaggattcagacacccctaccccacagctctgaccgtcaatgcttccgtgtcca

SEQ ID NO: 2948 - DNA, 80 bp, Homo sapiens
ctgactgctctgcttaaaggtgaaagtagcaggaacaacaacaaaagccaaccaaaaacaaggtagccagtgcaagacat

SEQ ID NO: 2949 - DNA, 76 bp, Homo sapiens
acttcggtgctacttaacaacttacatcccagggagcagtacgtggtccgagctagagtcaacaccaaggcccagg

SEQ ID NO: 2950 - DNA, 79 bp, Homo sapiens
aagaggaacggagcgagtccccgcgcgcggcgcgattccctgagctgtgggacgtgcacccaggactcggctcacacat

SEQ ID NO: 2951 - DNA, 85 bp, Homo sapiens
gacatggagaacaagctgtttgcggggattcggcgggacgggctgctcctgcgtttggtggatgatttcttgttggtgacacctc

SEQ ID NO: 2952 - DNA, 79 bp, Homo sapiens
aggcactgttcatctcagtttttctgtccctttgctcccggcaagctttctgctgaaagttcatatctggagcctgatg

SEQ ID NO: 2953 - DNA, 83 bp, Homo sapiens
ggtgtgccacagaccttcctacttggcctgtaatcacctgtgcagccttttgtgggccttcaaaactctgtcaagaactccgt

SEQ ID NO: 2954 - DNA, 75 bp, Homo sapiens
accagtcccccagaagactatcctgagcccgaggaagtccccccggaggtgatttccatctacaacagcaccagg

SEQ ID NO: 2955 - DNA, 65 bp, Homo sapiens
ggatcgagctcttccagatccttcggccagatgagcacattgccaaacagcgctatatcggtggc

SEQ ID NO: 2956 - DNA, 67 bp, Homo sapiens
gctacgagtgctgtcctggatatgaaaaggtccctggggagaagggctgtccagcagccctaccact

SEQ ID NO: 2957 - DNA, 67 bp, Homo sapiens
gtcatcacctggccttggtcctgtggaactggcagctgtcattgctggaccagtgtgcttcgtctgc

SEQ ID NO: 2958 - DNA, 66 bp, Homo sapiens
aacaccaatgggttccatctttctgggctcctgattgctcaagcacagtttggcctgatgaagagg

SEQ ID NO: 2959 - DNA, 85 bp, Homo sapiens
catccgcaaagtgactgaagagaacaaagagttggccaatgagctgaggcggcctcccctatgctatcacaacggagttcagtac

SEQ ID NO: 2960 - DNA, 67 bp, Homo sapiens
ggacaagaccctctcaggctgtcccaagctcccaagagcttccagagctctgacccacagcctccaa

SEQ ID NO: 2961 - DNA, 75 bp, Homo sapiens
tccctgcggtcccagatagcctgaatcctgcccggagtggaactgaagcctgcacagtgtccaccctgttcccac

SEQ ID NO: 2962 - DNA, 69 bp, Homo sapiens
tcaccctctgtgacttcatcgtgccctgggacaccctgagcaccacccagaagaagagcctgaaccaca

SEQ ID NO: 2963 - DNA, 67 bp, Homo sapiens
ctacctgccttgctttgtgacttccaagaacgagtgtctctggaccgacatgctctccaatttcggt

SEQ ID NO: 2964 - DNA, 73 bp, Homo sapiens
actttgctgggacaaaggtcaactgaagaagtgggcaggcccgaggcaggagagatgctgaggagtccatgtg

SEQ ID NO: 2965 - DNA, 84 bp, Homo sapiens
gccgggaagaccgtaattgtggctgcactggatgggaccttccagaggaagccatttggggccatcctgaacctggtgccgctg

SEQ ID NO: 2966 - DNA, 73 bp, Homo sapiens
aagcagaagggagagcgtaagatcttccaggcacacaagaattgtgggcagatgagtgagattgaggccaagg

SEQ ID NO: 2967 - DNA, 68 bp, Homo sapiens
cagaaggatgcctgtggccctcggagagcacagtgtcaggcaacggaatcccagagccgcaggtctac

SEQ ID NO: 2968 - DNA, 68 bp, Homo sapiens
gaaatcgccagcttcgataaggccaagctgaagaaaacggagacgcaggaaaagaacaccctgccgac

SEQ ID NO: 2969 - DNA, 71 bp, Homo sapiens
cacatcaaagaactactgacaacgaaggccgcgcctgcctttcccatctgtctatctatctggctggcagg

SEQ ID NO: 2970 - DNA, 66 bp, Homo sapiens
agctcggaacctcaccgtgcctggcagccttcgggctgtggacataccgggcctcaaggctgctac

SEQ ID NO: 2971 - DNA, 69 bp, Homo sapiens
ggagaagggtgaccgactcagcgctgagatcaatcggcccgactatctcgactttgccgagtctgggca

SEQ ID NO: 2972 - DNA, 70 bp, Homo sapiens
tctcacctcgctatggttcgtctgcctctgcagtgcgtcctctggggctgcttgctgaccgctgtccatc

SEQ ID NO: 2973 - DNA, 71 bp, Homo sapiens
cctcagcaccagggtaccaggagctgaggagtgtgagcgtgccgtcatcgactttgtggctttccaggaca

SEQ ID NO: 2974 - DNA, 74 bp, Homo sapiens
cttcatcttccctctacccagattgtgaagatggaaagggtccaacccctggaagagaatgtgggaaatgcagc

SEQ ID NO: 2975 - DNA, 72 bp, Homo sapiens
aatccaagggggagagtgatgacttccatatggactttgactcagctgtggctcctcgggcaaaatctgtac

SEQ ID NO: 2976 - DNA, 66 bp, Homo sapiens
tgtggacatcttcccctcagacttccctactgagccaccttctctgccacgaaccggtcgggctag

SEQ ID NO: 2977 - DNA, 82 bp, Homo sapiens
ctatatgcagccagagatgtgacagccaccgtggacagcctgccactcatcacagcctccattctcagtaagaaactcgtgg

SEQ ID NO: 2978 - DNA, 74 bp, Homo sapiens
tgctgttgctgagtctgttgccagtccccagaagaccatgtctgtgttgagctgtatctgtgaagccaggcaag

SEQ ID NO: 2979 - DNA, 81 bp, Homo sapiens
gggccaaatattcagaagcttttatatcagaggaccaccatagcggccatggagaccatctctgtcccatcatacccatcc

SEQ ID NO: 2980 - DNA, 68 bp, Homo sapiens
gcggacttaatgcagagacaaggccagtatgacccacctccaggagccagcaacattttgggacttga

SEQ ID NO: 2981 - DNA, 66 bp, Homo sapiens
gacgctggtctggtgaagatgtccaggaaaccacgagcctccagcccattgtccaacaaccaccca

SEQ ID NO: 2982 - DNA, 73 bp, Homo sapiens
cttcacagtgctcctgcagtctctctgtgtggctgtaacttacgtgtactttaccaacgagctgaagcagatg

SEQ ID NO: 2983 - DNA, 65 bp, Homo sapiens
gcctcggtgtgcctttcaacatcgccagctacgccctgctcacgtacatgattgcgcacatcacg

SEQ ID NO: 2984 - DNA, 69 bp, Homo sapiens
ggagccggatgcagtaggactggactcgggccatatccgtggtgccgtcaacatgcctttcatggactt

SEQ ID NO: 2985 - DNA, 68 bp, Homo sapiens
tgtcaccccgactcaacgtgagacgcaccgcccggactcaccatgcgtgaatgcatctcagtccacgt

SEQ ID NO: 2986 - DNA, 73 bp, Homo sapiens
cgaggacgaggcttaaaaacttctcagatcaatcgtgcatccttagtgaacttctgttgtcctcaagcatggt

SEQ ID NO: 2987 - DNA, 67 bp, Homo sapiens
gtatcaccatcaatgcggctcatgtggagtatagcactgccgcccgccactacgcccacacagactg

SEQ ID NO: 2988 - DNA, 74 bp, Homo sapiens
tgtgtatagtcctgcccctcaaggtgtcacagtaagatgtcggataatccgggataaaaggggaatggatcggg

SEQ ID NO: 2989 - DNA, 68 bp, Homo sapiens
ggaggagctaaatgcctcaggccggtgcactctgcccattgatgagtccaacaccatccacttgaagg

SEQ ID NO: 2990 - DNA, 522 bp, Homo sapiens
gagtcgaccctgcacctggtcctgcgtctgagaggtggtatgcagatcttcgtgaagaccctgaccggcaagaccatcaccctggaagtggagcccagtgacaccatcgaaaatgtgaaggccaagatccaggataaagaaggcatccctcccgaccagcagaggctcatctttgcaggcaagcagctggaagatggccgcactctttctgactacaacatccagaaggagtcgaccctgcacctggtcctgcgtctgagaggtggtatgcagatcttcgtgaagaccctgaccggcaagaccatcactctggaagtggagcccagtgacaccatcgaaaatgtgaaggccaagatccaagataaagaaggcatccctcccgaccagcagaggctcatctttgcaggcaagcagctggaagatggccgcactctttctgactacaacatccagaaggagtcgaccctgcacctggtcctgcgcctgaggggtggctgttaattcttcagtcatggcattcgc

SEQ ID NO: 2991 - DNA, 67 bp, Homo sapiens
acgcaccctgtctgactacaacatccagaaagagtccaccctgcacctggtgctccgtcttagaggt

SEQ ID NO: 2992 - DNA, 67 bp, Homo sapiens
tgtctggcgataaagggatttctgccttccctgaatcagacaaccttttcaaatgggtagggaccat

SEQ ID NO: 2993 - DNA, 73 bp, Homo sapiens
ctccataatttatggcctgcagtatctcttcttggagcccaaccccgaggacccactgaacaaggaggccgca

SEQ ID NO: 2994 - DNA, 73 bp, Homo sapiens
gtgaagccaccgtcatcatgtctgaccaggaggcaaaaccttcaactgaggacttgggggataagaaggaagg

SEQ ID NO: 2995 - DNA, 70 bp, Homo sapiens
accatgctccagaaggaggggccccgagccttctacaaagggttcatgccctcctttctccgcttgggtt

SEQ ID NO: 2996 - DNA, 66 bp, Homo sapiens
ccatgcagcctggaatttgaggctacccagtgccccaacccattctcctacgtgcccaggcctctc

SEQ ID NO: 2997 - DNA, 71 bp, Homo sapiens
tgcggaaatgagctccaccggctccctggccactggggactacactagagcagcggttagaatggctgagg

SEQ ID NO: 2998 - DNA, 67 bp, Homo sapiens
gacagctgatccaggagccacgggtcctgcacttcaaggacagttaccacaacctgcgcctatccat

SEQ ID NO: 2999 - DNA, 68 bp, Homo sapiens
agaacggaggccgtgactgcagcgggacgctgctcgactctaagaactgcacagatgggctgtgcatg

SEQ ID NO: 3000 - DNA, 69 bp, Homo sapiens
ctgaacacagtggagctggtttgcaaactctgtgtgcggcaggtggaaggagaagggcagatcttccag

SEQ ID NO: 3001 - DNA, 70 bp, Homo sapiens
gtggatgtgccctgaaggacaagccaggcgtctacacgagagtctcacacttcttaccctggatccgcag

SEQ ID NO: 3002 - DNA, 79 bp, Homo sapiens
acgggtcctgcctcagttggcggaatggcggccacgggagccaatgcagagaaagctgaaagtcacaatgattgccccg

SEQ ID NO: 3003 - DNA, 89 bp, Homo sapiens
tggcttcaggagctgaataccctcccaggcacacacaggtgggacacaaataagggttttggaaccactattttctcatcacgacagca

SEQ ID NO: 3004 - DNA, 68 bp, Homo sapiens
gataccacaactcccatcaagctgttggcagtggcagccacggcgcctcctgatgcgcctaacaggga

SEQ ID NO: 3005 - DNA, 67 bp, Homo sapiens
ggctttggcagcttcagattcccttcagggaaccagggtggagctggccccagtcagggcagtggag

SEQ ID NO: 3006 - DNA, 71 bp, Homo sapiens
gctgcgacatggatttcgacattgctgggccttccatccggggtgctctggtgctaggttacgagggctgg

SEQ ID NO: 3007 - DNA, 66 bp, Homo sapiens
acccacggacagacttgcgcgcgtccaatgtgtattcctccatcatatgctgaccttggcaaagct

SEQ ID NO: 3008 - DNA, 67 bp, Homo sapiens
gccctggatttcagaaagagccaagtctggatctgggaccctttccttccttccctggcttgtaact

SEQ ID NO: 3009 - DNA, 71 bp, Homo sapiens
ctgctgtcttgggtgcattggagccttgccttgctgctctacctccaccatgccaagtggtcccaggctgc

SEQ ID NO: 3010 - DNA, 73 bp, Homo sapiens
tgtgaatgcagaccaaagaaagatagagcaagacaagaaaatccctgtgggccttgctcagagcggagaaagc

SEQ ID NO: 3011 - DNA, 77 bp, Homo sapiens
agcttcctacagcacaacaaatgtgaatgcagaccaaagaaagatagagcaagacaagaaaaatgtgacaagccgag

SEQ ID NO: 3012 - DNA, 71 bp, Homo sapiens
tgacgatggcctggagtgtgtgcccactgggcagcaccaagtccggatgcagatcctcatgatccggtacc

SEQ ID NO: 3013 - DNA, 83 bp, Homo sapiens
cctcagcaagacgttatttgaaattacagtgcctctctctcaaggccccaaaccagtaacaatcagttttgccaatcacactt

SEQ ID NO: 3014 - DNA, 72 bp, Homo sapiens
tgcccttaaaggaaccaatgagtccctggaacgccagatgcgtgaaatggaagagaactttgccgttgaagc

SEQ ID NO: 3015 - DNA, 67 bp, Homo sapiens
tacaagctgagtgcccaggcgggtgccgaaatggaggcttttgtaatgaaagacgcatctgcgagtg

SEQ ID NO: 3016 - DNA, 75 bp, Homo sapiens
agaggcatccatgaacttcacacttgcgggctgcatcagcacacgctcctatcaacccaagtactgtggagtttg

SEQ ID NO: 3017 - DNA, 74 bp, Homo sapiens
acaaagctaccagggagtcggcctttgtccacgccattgcctcagccggtgtggcctttgcagtgacacgctca

SEQ ID NO: 3018 - DNA, 75 bp, Homo sapiens
gtatcaggaccacatgcagtacatcggagaaggcgcgaagacaggcatcaaagaatgccagtatcaattccgaca

SEQ ID NO: 3019 - DNA, 79 bp, Homo sapiens
tgtcttcagggtcttgtccagaatgtagatgggttccgtaagaggcctggtgctctcttactctttcatccacgtgcac

SEQ ID NO: 3020 - DNA, 67 bp, Homo sapiens
cggtggaatctggctctggctccctctgctcttgacctggctcacccccgaggtcaactcttcatgg

SEQ ID NO: 3021 - DNA, 74 bp, Homo sapiens
atcgcagctggtgggtgtacacactgctgtttaccttggcgaggcctttcaccaagtccatgcaacagggagct

SEQ ID NO: 3022 - DNA, 76 bp, Homo sapiens
gggtagagggaaaagggttcaacaaaggctgaactggattcttaaccaagaaacaaataatagcaatggtggtgca

SEQ ID NO: 3023 - DNA, 73 bp, Homo sapiens
gatacatcgtctgcgaggaattcaaagacgtgctcctgactgcctgggaaaatgagcaggcagtcattgaaag

SEQ ID NO: 3024 - DNA, 70 bp, Homo sapiens
ggagatgaagcccccaagcttcctcagaagcaaccccagaccaaaaccaagcccactcaggcagctggac

SEQ ID NO: 3025 - DNA, 76 bp, Homo sapiens
agactgtggagtttgatgttgttgaaggagaaaagggtgcggaggcagcaaatgttacaggtcctggtggtgttcc

SEQ ID NO: 3026 - DNA, 68 bp, Homo sapiens
catggcctccgctatgaaggcggtgacagagctgaatgaacctctctccaatgaagatcgaaatctcc

SEQ ID NO: 3027 - DNA, 66 bp, Homo sapiens
ctgcgttcacaccccagtgtcacagggcgagctgttctggagagaaaaccatctgtcgtggctgag

SEQ ID NO: 3028 - DNA, 72 bp, Homo sapiens
tgctgagcctcctctccttggcaggggcactgtgatgaggagtaagaactcccttatcactaacccccatcc

What is claimed is:

1. A method for obtaining a Recurrence Score (RS) result for a patient with colorectal cancer, comprising:
    measuring levels of RNA transcripts of a set of genes consisting of BGN, FAP, INHBA, MYBL2, Ki-67, cMYC, and GADD45B, and at least one reference gene in a tumor sample obtained from the patient;
    normalizing levels of the RNA transcripts of BGN, FAP, INHBA, MYBL2, Ki-67, cMYC, and GADD45B against the levels of the RNA transcripts of at the least one reference gene to provide normalized levels of the RNA transcripts of BGN, FAP, INHBA, MYBL2, Ki-67, cMYC, and GADD45B;
    assigning the normalized levels to gene subsets comprising a stromal group and a cell cycle group and a cell signaling group, wherein the stromal group comprises FAP, BGN, and INHBA, and the cell cycle group comprises Ki-67, cMYC, and MYBL2 and the cell signaling group comprises GADD45B;
    wherein the level of normalized RNA transcripts from the stromal group selected from BGN, FAP, and INHBA is measured to obtain a stromal group score, the level of normalized RNA transcripts from the cell cycle group selected from MYBL2, Ki-67, and cMYC is measured to obtain a cell cycle group score, and the level of the normalized RNA transcript of GADD45B is measured to obtain a cell signaling group score, wherein the stromal group score, cell cycle group score, and cell signaling group score equal the sum of the normalized RNA transcript levels for each gene of the group divided by the number of genes in the group;
    weighting the stromal group score by +0.15, weighting the cell cycle group score by −0.3 and weighting the cell signaling group score by +0.15;
    calculating a Recurrence Score (RS) result for the patient using the weighted gene group scores; and
    generating a report comprising the RS result.

2. The method of claim 1, wherein the normalized levels of the RNA transcripts are further calculated as a ratio of the normalized levels to tumor region, wherein the tumor region is tumor-associated stroma unit area or tumor epithelia unit area.

3. The method of claim 1, further comprising:
    measuring a surface area of tumor-associated stroma in the tumor sample and calculating a Stromal Risk Score based on the surface area of the tumor-associated stroma,
    wherein increased Stromal Risk Score is positively correlated to increased risk of recurrence of cancer for said patient; and
    wherein the report further comprises the Stromal Risk Score.

4. The method of claim 1, wherein the tumor sample is obtained from a biopsy.

5. The method of claim 1, wherein the tumor sample is fresh or frozen.

6. The method of claim 1, wherein the levels of the RNA transcripts are measured by reverse transcription polymerase chain reaction (RT-PCR).

7. The method of claim 1, further comprising scaling the RS result on a scale of 0 to 100, wherein the scaled RS result=0 if $44\times(RS+0.82)<0$, the RS=100 if $44\times(RS+0.82)>100$, and wherein the scaled RS result=$44\times(RS+0.82)$ when $44\times(RS+0.82)$ has a value $\geq 0$ and $\leq 100$.

8. The method of claim 1, further comprising determining a recurrence risk group tier for the patient based on the patient's scaled RS result in comparison to a set of at least three previously defined recurrence risk group tiers.

9. The method of claim 8, wherein the recurrence risk group tiers comprise a low risk group tier if the patient's scaled RS result is <30, an intermediate risk group tier if the patient's scaled RS result is ≥30 to <41, and a high risk group tier if the patient's scaled RS result is ≥41.

10. The method of claim 1, wherein the RS result for the patient is calculated from the sum of the weighted stromal group score, the weighted cell cycle group score, and the weighted cell signaling group score.

11. The method of claim 1, wherein the tumor sample is a paraffin embedded and fixed sample.

12. The method of claim 1, wherein the at least one reference gene comprises one or more of ATP5E, PGK1, GPX1, UBB, and VDAC2.

13. The method of claim 1, wherein the at least one reference gene consists of one to five genes.

14. A method for obtaining a Recurrence Score (RS) result for a patient with colorectal cancer, comprising:
extracting RNA from a tumor sample obtained from the patient;
reverse transcribing RNA transcripts of a set of genes consisting of BGN, FAP, INHBA, MYBL2, Ki-67, cMYC, and GADD45B, and at least one reference gene to produce cDNAs;
amplifying the cDNAs to produce amplicons of the RNA transcripts of the genes;
assaying levels of the amplicons;
normalizing the levels of the amplicons of BGN, FAP, INHBA, MYBL2, Ki-67, cMYC, and GADD45B against the level of the amplicon of the at least one reference RNA transcript in said tumor sample to provide normalized amplicon levels of the BGN, FAP, INHBA, MYBL2, Ki-67, cMYC, and GADD45B RNA transcripts;
assigning the normalized amplicon levels to gene subsets comprising a stromal group and a cell cycle group and a cell signaling group to obtain a stromal group score and a cell cycle group score and a cell signaling group score, wherein the stromal group score equals the sum of the normalized amplicon levels of FAP, BGN, and INHBA divided by three, the cell cycle group score equals the sum of the normalized amplicon levels of Ki-67, cMYC, and MYBL2 divided by three, and the cell signaling group score equals the normalized amplicon level of GADD45B;
weighting the stromal group score by +0.15, weighting the cell cycle group score by −0.3, and weighting the cell signaling group score by +0.15;
calculating a recurrence score (RS) result for the patient from the sum of the weighted stromal group score, the weighted cell cycle group score, and the weighted cell signaling group score; and
generating a report comprising the RS result.

15. The method of claim 14, wherein the tumor sample is fresh, frozen.

16. The method of claim 14, further comprising:
measuring a surface area of tumor-associated stroma in the tumor sample and calculating a Stromal Risk Score based on the surface area of the tumor-associated stroma,
wherein increased Stromal Risk Score is positively correlated to increased risk of recurrence of cancer for said patient; and
wherein the report further comprises the Stromal Risk Score.

17. The method of claim 14, wherein the tumor sample is obtained from a biopsy.

18. The method of claim 14, further comprising scaling the RS result on a scale of 0 to 100, wherein the scaled RS result =0 if 44×(RS+0.82)<0, the RS=100 if 44×(RS+0.82)>100, and wherein the scaled RS result=44×(RS+0.82) when 44×(RS+0.82) has a value ≥0 and ≤100.

19. The method of claim 14, further comprising determining a recurrence risk group tier for the patient based on the patient's scaled RS in comparison to a set of at least three previously defined recurrence risk group tiers.

20. The method of claim 19, wherein the recurrence risk group tiers comprise a low risk group tier if the patient's scaled RS is <30, an intermediate risk group tier if the patient's scaled RS is ≥30 to <41, and a high risk group tier if the patient's scaled RS is ≥41.

21. The method of claim 14, wherein the tumor sample is a paraffin embedded and fixed sample.

22. The method of claim 14, wherein the at least one reference gene comprises one or more of ATP5E, PGK1, GPX1, UBB, and VDAC2.

23. The method of claim 14, wherein the at least one reference gene consists of one to five genes.

24. A method of analyzing the expression of RNA transcripts of genes in a colorectal cancer patient, comprising:
extracting RNA from a tumor sample obtained from the patient;
reverse transcribing RNA transcripts of a set of genes consisting of BGN, FAP, INHBA, MYBL2, Ki-67, cMYC, and GADD45B, and at least one reference gene, in the tumor sample to produce cDNAs, wherein a reference gene is a gene that does not exhibit a significantly different RNA expression level in in cancerous colorectal tissue compared to non-cancerous colorectal tissue; and
amplifying the cDNAs to produce amplicons of the RNA transcripts of the genes for use in determining expression levels of the RNA transcripts.

25. The method of claim 24, wherein the at least one reference gene comprises one or more of ATP5E, PGK1, GPX1, UBB, and VDAC2.

* * * * *